United States Patent 6,380,370 (NUCLEIC ACID AND AMINO ACID SEQUENCES RELATING TO STAPHYLOCOCCUS EPIDERMIDIS FOR DIAGNOSTICS AND THERAPEUTICS) - sequence listing, part 2

SEQ ID NO: 2974 - protein, 553 aa, Staphylococcus epidermidis
IERGIQMTQNSYKIPIQGMTCTGCEEHVTEALEQAGAKDVSADFRRGEAIFELSDDQIEKAKQNISAAGYQPGEEESQPSENSVDFNRDGDYDLLIIGSGGAAFSAAIKANENGAKVAMVERGTVGGTCVNIGCVPSKTMLRAGEINGLAQNNPFTGLQTSTGAADLAQLTEQKDGLVSQMRQEKYIDLIEEYGFDLIRGEASFIDDKTIQVNGQNITSKSFLIATGASPAVPEIPGMNEVDYLTSTSALELKEVPQRLAVIGSGYIAAELGQMFHNLGTEVTLMQRSERLFKTYDPEISEAIDESLTEQGLNLITGVTYQKVEQNGKSTSIYIEVNGQEQVIEADQVLVATGRKPNTETLNLESAGVKTGKKGEVLTNEYLQTSNNRIYAAGDVTLGPQFVYVAAYEGGIVANNALGLAKRKIDLRFVPGVTFTNPSIATVGLTEQQAKEKGYDVKTSVLPLDAVPRALVNHETTGVYKLVVNAQTQKLIGAHIVSENAGDVIYAATLAVQFGLTIEDLTDSFAPYLTMAEGLKLAALTFDKDVSKLSCCAG

SEQ ID NO: 2975 - protein, 204 aa, Staphylococcus epidermidis
IVGGIINVFNTTYKEIYSMFPNKPYPVHDIYEDCRTILADLQIEMFNRINKQLYKTCHYNKPRKHHEMIKKLLIEFIIDNKDSKIVSAEPFELNLEAFYAIKQNCNISNNNKPLDEYIITYFEDLLSNISNTLTNNNRANGNNPIINYIYVTQRKDGMVCVVGKSHFKYEFKGNEYKLVKNQEGDLLRRWMKIKVPEKYYLHCI

SEQ ID NO: 2976 - protein, 296 aa, Staphylococcus epidermidis
LKGGDILDRAFRILTIYNRLLQNKSVNKQSLTLELDTSPRTIQRDIDDIRNFLYESKSWISAPKEITYDYKSESYKLEQNKSENMYFMYDILTALYLTTPKLSHYFYQYLKLLIVKHHSNYRTTLLKYLERFEIDKNQTGISTSSLVVQAMNENQYLQYNQNLLLPLSMYYQMHAFHLVYRMNDEIHIDDINQMNLSLSEKSVDTHEKSKVQTYITFEISKDVWSKMHRYYQIHVIEKYDAHYLIVTFKMTRIEAIQLCFMYRSNIRIISPPDLKEQVIDELLLLQTTYLKQQVQK

SEQ ID NO: 2977 - protein, 112 aa, Staphylococcus epidermidis
IIRGVFFSMKRVSYSVETKYKAVEMKAAGFSTKEIMKELNIRNRTQVKTWWRWYRNGESYRFSQHVGKQYTYGKGLEELLEVEQLKLENKRKDIELDILKKYKALERKWYQQ

SEQ ID NO: 2978 - protein, 189 aa, Staphylococcus epidermidis
NSFIGHTMLLGKCLGGMAMDSHLNHILSYWQGPPLEGAKTIISKYGYPQEATMRRLIWYNSGPWKRTIVYKDPVPHNFPTPHLDFLKQTIDYKVPVHLYDAIAAFDGSVYLDRTTGEASAKCHEEAMNFLSLNLLNDIVTGKRDVQGAKAFYAQTAEQFTKYHITSPYTEGFLFPMQYNTADLGVTYFK

SEQ ID NO: 2979 - protein, 460 aa, Staphylococcus epidermidis
IYIITVKGGADMKQVIGYLRQSTMKQQSLAAQKQAIEAIAEKHHIQHINFYSDKQSGRKDNRSGYRQITQLIQQGQCDILCCYRLNRLHRNLKNALKLIKLCQTYHVHILSVHDGYFDMDQAFDRLKLNIFISLAELESDNIGEQVRNGLQEKAKQGRLITTHAPFGYEYHNGTFIINQNESPTVKAVFNYYIKGHGYKKIAQLLEEDNTYINRQPYQVRNIIINPNYCGRVNNQYGQFDNMFPSIVSTSIYEQAQRLRLQKQTKQTPSDNQLKQKIKCPCCNATLTNMTIRKKNHTLRYYVCPKNMNASRFVCDFKGINAQTLEDKVLEVCRDFYQNQRIYTKIKSAIDKRIKRQRNIEKHHTLTQEQLIEKLAQGIIDAETFREQTQSLRQQPQRTTSINGHQIQHIIQNIIQKRFTLNILYPYIETIHITKDKNLIGIYFKNEPLNIVNQTMQSSIA

SEQ ID NO: 2980 - protein, 504 aa, Staphylococcus epidermidis
MATIGFEEKLWQAADKLRGSMDAAEYKNVALGLIFLKYVSDSFEEKYEELKQDPYADEEDQDEYLAENIFWVPKEARWQYINDNAKKPEIGQIIDKAMIAIENENESLKGVLPKEYARPALDKEKLGDIIDLFTFKVGDTESRKQDVLGRVYEYFIAKFASAEGKNAGEFYTPSSIVKLLVEMIEPYKGRIYDPCCGSGGMFVQSERFVEKHQGRLDDIAIYGQESNPTTWKLAKMNLAIRGIDNDLGERNSDTFHNDLHKGLKADYILANPPFNASDWGQERLLDDYRWQFGIPPKGNANYAWIEHMISKLAPNGTAGFVLANGSMSTSGKDELEIRKNLIEQDLVECIVTLPGQLFYSTQIPVCLWFISNNKGQNGKKERKNEILFIDAREIGHMVSRTLKEFSDEDIQKVAQTYHAWRGTNDKPYEDIAGFCKVANLEEVKNNEYILTPGRYVGLADVEEEEEPFEQKMERITSELSEQFAKSKELEDQIRKSLEGLGYGV

SEQ ID NO: 2981 - protein, 430 aa, Staphylococcus epidermidis
IMTILAIIIFLLTLMFVIWQPKGLDIGITALIGAIIAIITGVVSLSDVIEVTGIVWNATLTFVAVILISLILDEIGFFEWAAIHMVRASNGHGFKMFVYIMLLGAIVAAFFANDGAALILTPIVLAMVRNLGFNQKVIFPFIIASGFIADTTSLPLIVSNLVNIVSADYFNIGFIEYVSRMIIPNIFSLIASIVVLWLYFRKVIPNNFEIKNLKTPNQAIKDPKLFKFSWIVLSILLIGYIVSEFIQIPVSLIACLIALIFTVLAYKSRVVNTKQVIKGAPWNIVLFSIGMYLVVFGLKNVGITALLANILSSISNYGLFSSVIGMGFISAFLSAIMNNMPTVLIDAIAIGQSATTGLIKEGMIYANIIGADLGPKITPIGSLATLLWLHVLTQKGVKISWGTYFKTGIVITIPVLFITLVGLYVTLIVF

SEQ ID NO: 2982 - protein, 138 aa, Staphylococcus epidermidis
GDNMEMKISELAKACDVNKETVRYYERKGLIAGPPRNESGYRIYSEETADRVRFIKRMKELDFSLKEIHLLFGVVDQDGERCKDMYAFTVQKTKEIERKVQDLLRIQRLLEELKEKCPDEKAIYTCPIIETLMGGPDK

SEQ ID NO: 2983 - protein, 314 aa, Staphylococcus epidermidis
KEDINMSKIVVALGGNALGQSPKEQLDLLKSTSKSLVSLIDKGYEIVISHGNGPQVGSINLGLNYAAEHKQGPPFPFPECGAMSQAYIGYQMQESLQNELHSMGIDKQVVTLVTQVQVASDDSAFNNPTKPIGLFYTKEQADKFTKEKGYTFVEDSGRGYRRVVPSPQPISIVELDSIETLITHGTLVIAAGGGGIPVIKENEVYTGVDAVIDKDKTSALLAAHLQSDQLIILTAVDHVYINYGKENQRGLDEVSVDEMKKHISDGQFAKGSMLPKVEAALQFLEKNTKGSVLITSLAGLGDALDGKIGTLIKN

SEQ ID NO: 2984 - protein, 110 aa, Staphylococcus epidermidis
LGGIFMSYKELSAILKVLSDPSRLEILDLLSCGELCACDLLAYFQFSQPTLSHHMKILVDNELVSTRKDGTKRMYRLNHTFLDSINKELTYISSPTQQCMCKKIKTGECK

SEQ ID NO: 2985 - protein, 178 aa, Staphylococcus epidermidis
CFYIKIKIKEVNLMYNKVFAILIIIFSIIIIASNDTFAESKNDMMNMKEDKKSTMDMTNMKHHDERKKLNSSQGKNEIIFPEVAESKKDNNGYKNYTLKAQKGKTEFYKNNFSNTLGYNGNLLGPTLKLKKGDKVKIKLINNLDENTTFHWHGLEVNGKVDGGPSHVIKPGKEKNYKI

SEQ ID NO: 2986 - protein, 347 aa, Staphylococcus epidermidis
KNNMNKILIEKEIFKMKNLRNRNFLTLLDFTQKEMEFLLNLSEDLKRAKYAGIEQQKMKGKNIALLFEKDSTRTRCAFETAAYDQGAHVTYLGPTGSQMGKKESTKDTARVLGGMYDGIEYRGFSQRVVEDLAKYSGVPVWNGLTDEDHPTQVLADFLTAKEVLKKPYNEINFTYVGDGRNNVANALMQGAAIMGMTFHLVCPKELNPTDELLNRCNDIADKNGGEILITDDIDEGVKGSDVIYTDVWVSMGEPDEVWEKRIKLLEPYRVTKELMKKTGNPHTIFEHCLPSFHDTETIIGKQIQEKYGLTEMEVTNEVFESEQSVVFQEAENRAHTIKAVMVATLGE

SEQ ID NO: 2987 - protein, 308 aa, Staphylococcus epidermidis
YWVLFLQYLAINKTKVLVKNMNLNDLEAFYKVCENRSFTKAAQELNYVQSNVTAKIQRLESYYQVKLLYRDKKGIKPTPEGIELLKYIKRIFTILHEAEHNVSNNKKLNINIGTIETIAAVHLPKLLNEYKRKNPKIQINLKTDNSIKLIEHVKNREMDCAFISGNINDKDLICTNIFNEKLVILSQKSNFKQNINENKSIIMFGEGCFYRKIFEDWLNYHDINIENKMTLNTLDGILGCVEAGLGIAFLPMSVLNKGNSDGIEITKVEESFQTISLNIIYRQDNKNNNVINQLKQVAFEKMKSNIIK

SEQ ID NO: 2988 - protein, 107 aa, Staphylococcus epidermidis
ITLIIMKGMGIMSNIIKTIGKGIGKGVGAAAYYSVATVGAAIGAIWETTGDRGLMRDALSDSSNQDLIEIYEIQKKDDGDYDTYIAAKSLLQERGFTYNHETNKWEK

SEQ ID NO: 2989 - protein, 182 aa, Staphylococcus epidermidis
KVLIMNLTTQITKMLGIKYPIIQAGMAGSTTPELVSTVSKQGGLGMIGAGYFDSHQLSKEILEVQKLTQAPFAVNLFTPNDIKYDKKQIEQMNTKLKPYREALGLSTPKNSTVKEKEKFEDAIEVIESLKVPIIAFTFGIPNQNIIKRLHNAGKILIGTATSVEEAVENGKCWYGYSCSPGL

SEQ ID NO: 2990 - protein, 77 aa, Staphylococcus epidermidis
EVIMMTLEQQLKHYITNLFNLPKDEKWECESIEEAADDILPEQHVRLGPLSNKILQTNTYYSYTLHKSNIYPFILYY

SEQ ID NO: 2991 - protein, 157 aa, Staphylococcus epidermidis
SKIIKGVIKMKKEKRLNLILTVIQQNQFNKKQQIVDYMARHFGVYYSLTTISRDLQELEIYKIPVENKKYIYKKINQTNQLSAKKQLEIFSDEIIEFITLNNYVLIKTSPGFAQSISYYIDQLQMKEILGIIGGNDTLMILTSSNEIAEFVCYQLFP

SEQ ID NO: 2992 - protein, 154 aa, Staphylococcus epidermidis
LPQIVDDVSIPVIAAGGIMDGRGLVASLALGAGAAQLGTAYLTTNESGADDKIKNEIIESSETDTILTNVFSGKLARGIMNEFVHNMNLYSKQVPPYPLQNQLTTQIRKSALEKGYTEWTHIWSGQSTRLADTVDAAQLTKNIINDAVKIINNK

SEQ ID NO: 2993 - protein, 912 aa, Staphylococcus epidermidis
GEQMKNIDIAIYDIDKVICKSIENNSSDLGYLSQSILSHLRNYVEHIGMKYYFESVNEDMTNSSSNIYNEIQMGIGYFRKHYKLNWLKNFHELLQQSVSHYTFDEDRSERLFIKYYDLMLELKEKLKKDFEMDLLQNLYKVPLNIDSDLKGYYHTISQLIGNKYTDNEYEVDNSRYYIEKTKPFVIENKVYYEITFRNANDKTSKYERLIGYSKHRINTNYAVKFALEMQTISYLGIKANVIIINDYEISIRPCEFNNFAKILDYDLKLQSNHNEYKKLMKLLKEFNLHLLDIVLLDDDEFNELECSVNSESAVINIFNVLRLARRYILTNKSGANVLRYLLFVFNNRIIRLQLPYNRNKCYKLSNLILDYKCVPFDQMPFTASLKGHNPNIYTLLQCIEYKGREYELLVRKIQKNTLKNKKVYTSKEEIEQYGVVNELIDKYNNNLYYKHRPNREIHSFGDKYYLYENEQSIMSIIKSIKLLSNESVEGYSNSVEFWLNNEYTSLDCKEKKEILLRMFSNSKISMVYGAAGTGKSTLINHICNFFYDKDVIVIANTNTAVDNIKRKIKLSNIKTSTISKFLYNDKEKYDLLIIDEAGTVSNKDMNRILENKQFELLLIVGDNYQIESIDFGNWFEIAKDVLSKNIINELTDMYRTKNDDLLYFWKSVREKKSNLNEIINMNKYSTRLDESIFNEFNKDEIILCLNYDGIYGINNINRLLQANNKNDSVIWGVKEYKVGDPILFNETNKYSPILFNNLKGSIIEIHVFEEYILFDLEINKVINELDIISLEIDLISSSENSSVIRIRVEKSDGLNDDDNDSSDSIVPFQVSYAISIHKAQGLEFNSVKIVISDDLDEQITNNIFYTAITRARENLKIYWSPRTEKKIIDNIISKRNLKDLSILKSRIKKQNT

SEQ ID NO: 2994 - protein, 607 aa, Staphylococcus epidermidis
QQPFERRCSLMTQTNPSFNPSPRYKSKKGWYKDKPPKEKGGMPTEVEIAGPIVIENKFIDPKTNTEKVIITDEDQKVIVESSDILTTQKLPSLMKYGFSINEKYTKDLGYALQQMRNQLPISYLYEGVGILETPFGPIVSLNEIYTTTEFDNKSPSDAICENTYDLAPRGTFDNWFNMYIDEVKDHLLLELTVIFGISALVTSFLKHKHEIEFAGILFSFTGQSSTGKSTAAALAVSVAGNPTKGNETLFRSWNATRNALEGYLSNNYGVPIVFDELSSTTLKDTTGLLYSIAEGQGRQRSNVHGEVKAPKNWGTSVISTSEYSIFNDSAQNDGLRVRTIEINEQFTTNATNADNIKKAVALNYGHVLPLVAKYLINREDEVIQWFYKEVDWFEAKLKDETNNTGIRMFKRYAVITTSAKILGRVLSTDIDIANIRDYFIDYHTHTVSERSLADKAIDVIIQFVAQNRGKFSDEGALKNMFENYGLISLKDDHIEVKIIANVFKQMLNNHQFQDVNNVVNALRDKGFILADRGRQTTKRSVKDNSGKKQSLVFYHLKLDVEFASILGLTKDKSLLQNWTPSNDNKAAKELFKSANEGIGPSGVHEDF

SEQ ID NO: 2995 - protein, 274 aa, Staphylococcus epidermidis
LGGIMKNFKVQEAKETPLSAQNANVFIKCVKKYNWLKDIIINGYFQYRYVTEEVEYLNIETTDLSGKRIPIEDITFPMLCFCDIPLNQLKDHNKWYGDYAICMKKSWGVNKNLQPLHYVSNTSEYIKMYQEVFNNIVNKPDTDEKVYEFIFASLFFLKHFKGSQYCEKTDKIEEKIFMDEQEWRSIKLVDEDLDPFYINENSDSKRNYYNEALTKLSSNKLEFNCEDIRYIIVEKEEDVIQLINDINCSNYDDQEKSLLISKISVLNHLREDFM

SEQ ID NO: 2996 - protein, 509 aa, Staphylococcus epidermidis
KRVIIMIKNKWKIELWFQFFSYFIHKIDSEFILKEYAQHILPEEMRTNYVVGEAQPNETIYISYFVNTSNQNIEQHTVKCSEEGIFIDKIPSGFTKDNLTYSIDSQSMVDIDELSNEIIDQGVDALDVLESTTLDTYFTEFLTTINKTTDFAKKIANNTIKQIRENIELKKANYRIDYEKAIDDVSSLESFINLKDTILETHQDLSKENFDDVLISDFLTKYLIYKEKQDSYVKKNISNLNKSNYFKQLVTEGLIKERTSNSQYFEIANSIKPSIHNKYSLNQSDELDQFRQAVIGISLNLYDQNDTYFKFIRSILTEKSRKVNLTIDGLIESQNTINEFMKKQDLISDNELYYLTTIEDTFHFALFTAISDLMDELVLVTSKIIQSATQYDVLVALYSISNLKNDLNKLAHKHERSLTRFKSLIDGYVRNTRLKDLIHNIIMNDIKMTEKVERSLLTDLKKYNISNFYKRDNFNNNPNDFLDKLMIQIISKFYKTRLEDINDGPNLYY

SEQ ID NO: 2997 - protein, 113 aa, Staphylococcus epidermidis
LEEIDSFNELFYLIELYLKAFKGQKKTGYEFEERLNTFIQSYVIILLIDIRLPTVRLYIIRHIVDTCEKEVDNQKRIILIEKSIKKYRYVKEQIKRFGNALKEELSNATLSIE

SEQ ID NO: 2998 - protein, 188 aa, Staphylococcus epidermidis
RGRFLLCDAFTRRILKEVTMMNTIKSTIHTEAIFSDDEQHRYLLKKTWDEKKAACTVITMYPHLDGVLSLDLTTVLILNQLANSERYGAVYLVNLFSNIRTPENLKHIKNPYDEHTDIHLMKAISESDTVILAYGAYAKRPVVIDRVEQVMEMLKPHKKKVKKLINPVTNEIMHPLNPKARQKWILKS

SEQ ID NO: 2999 - protein, 64 aa, Staphylococcus epidermidis
TLSVSISLRRFFIINYFILFDLSPGLVIFLIFLIYTLKNILLNNNKLFKLLIKEDIFISIYFSI

SEQ ID NO: 3000 - protein, 89 aa, Staphylococcus epidermidis
LFLVMIGYVDQIGREIGGVVFMVSCCSIDPYTEFEVIIIGAGVPEVSLAFHLTSYGIRTALADEQNVDNRLKDFLRTFQELIERDSGMP

SEQ ID NO: 3001 - protein, 496 aa, Staphylococcus epidermidis
KSQVIHSLNQITRFLPPLLGEINMDENKLGKTSLIGLVIGSMIGGGAFNIISDMGGQAGGLAIIIGWIITAIGMISLAFVFQNLTNERPDLDGGIYSYAQTGFGDFIGFSSAWGYWFAAFLGNVAYATLLMSAVGNFFPIFKGGNTLPSIIIASILLWGVHFLILRGVETAAFINSIVTVAKLIPIFLVIICMIVVFNFSTFKSGFYGMTSGSVGVFSWGDTMAQVKSTMLVTVWVFTGIEGAVVFSGRAKSKKDVGTATVIGLISVLVIYFLMTVLAQGVIHQNQISKLANPSMAQVLEHIVGHWGSVLVNIGLIISVLGAWLGWTLLAGELPFIVAKDGLFPKWFAKENKNKAPVNALIITNILVQLFLISMLFTDSAYQFAFSLASSAILIPYTLSAFYQVKYTIQNKSKANLKQWIIGIIASIYTIWLVYAAGLDYLLLTMLLYIPGLLVYSYVQRDNNKHLTKLDYTLFIFIIVLAIIGIVRLITGNISVF

SEQ ID NO: 3002 - protein, 76 aa, Staphylococcus epidermidis
LLKVLNRVDLLVEISTYVALLNAQNAEIIWYVDGRIIKRKSPKNGQSSGITFVPYSIVQGVLHVTVIPSMLKSSSV

SEQ ID NO: 3003 - protein, 381 aa, Staphylococcus epidermidis
IKGVLEVKTRAAVLHEMGAKKPYKESKPLKIEYLELDNPSEHEVLIKIHAAGLCHSDLSVINGNRPRPLPMALGHEASGEVIKVGKAVTRVSEGDHVVCTFIPSCGKCIPCKEGRPALCENGAISNEKGEMLEGGMRLSNDEGKVYHHLGISGFAEYSVVSENSIVKIDKKIPFERAAAFGCAIITGIGAVVNTAQIRSGSNVAVVGLGGIGLNAIIGAKLAGANEIIALDINEDKFELAKQFGATATFNSSDKDIDEQIKEYIPGGVEYAFETAGVVPAMKVAYQITKRGGTTVTTGLPNPKDNFSFPQVTLAAEERTIKGSYVGSCVPDRDIPRFVNLYNQGRLNIDSLISEVITLDEINEGFDRLSNGEVGRIIMKMH

SEQ ID NO: 3004 - protein, 80 aa, Staphylococcus epidermidis
SKGVLSMNHDNTIQSNWRTVASCLASQNYISIVKGLVHHFTAIDDEEILDKIYEEFINDDSITTVLNNDLQTIINHYLSK

SEQ ID NO: 3005 - protein, 87 aa, Staphylococcus epidermidis
QKGVFCMNYFRYKQFNKDVITVAVGYYLRYALSYRDISEILRERGVNVHHSTVYRWVQEYAPILYQIWKKKHKKLITNGVLMRRTSK

SEQ ID NO: 3006 - protein, 64 aa, Staphylococcus epidermidis
IVSLSFLKRLSNISLCFLHKYSSKSFGKVNILQSVKAVHISYGAGVSLNMKFIGNIFSSLLNLK

SEQ ID NO: 3007 - protein, 65 aa, Staphylococcus epidermidis
SNTLHRSDKMPSRWVKVKTFKSLSTSKLEKKLQNFKSYNSFDIIEIKRHSYLFLNIVEVYYKDKT

SEQ ID NO: 3008 - protein, 71 aa, Staphylococcus epidermidis
LWAFLAIQRPSSVLPKLAYRFSQQVGKQYTYGKGLEELSEVEQLKLENKRKDIELDILKKYKVLERKWYQQ

SEQ ID NO: 3009 - protein, 303 aa, Staphylococcus epidermidis
FNKFGGVILMIDSIIEFIKTFLMLFFELLILFIIVSFIVSLIQQVVSEDKIKSMLSKPNQGINYFFGMIFGAITPFCSCSTIPILAGLLNSKVPFGPAVSFLIASPLMNPLMVFMLWVLLGWKVAIVYFIVLAIFSIFTGLVFSKMNLAESYKGVNVKGDGFFANKEGSRFKQALNDAWAFLYPMLPYLFIGVFIGAFIYGFVPETFITKYASGDGVISVFIGSVIGIPMYIRPETMLPIAEALVSKGMSLGTVVALIIGGAGASIPEVVLLTKLFKKKFVVSFVIAILVVAIATGLIVNIVI

SEQ ID NO: 3010 - protein, 110 aa, Staphylococcus epidermidis
HDKLVVSYIFLLCNRTLFFGATWGPIMWVMLPEMFPTRARGAATGIAIVVLQIGTLIISQVFPILVNMLEVQYVFLIFAVIGALALIFVVKFLPETRGKSLEEIELQLQN

SEQ ID NO: 3011 - protein, 80 aa, Staphylococcus epidermidis
VAKFIGKGTYIEDIVNGSFLKSQDDLKLKASDFTVEDNYNYGVLIFPENLSLTDNNKKLESLIKTILFTGKRYQYTYFKI

SEQ ID NO: 3012 - protein, 149 aa, Staphylococcus epidermidis
TLISQELLIQKIQDADALITLLSTQVSRQVIESAPKLKIIANYGAGFNNIDIQAAREHHINVTNTPIASTNATAELTMGILLAVARRIPEDDQLCHNEGFNLKITDDNLQVDYPRQFLKGAHAPSVKAQHVIHWGDTFWVSSLWLAWFY

SEQ ID NO: 3013 - protein, 457 aa, Staphylococcus epidermidis
RVISVRRIMMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 3014 - protein, 122 aa, Staphylococcus epidermidis
IKEFSIMKNKKGLGIGLITIMIIVCIVLVIMMFVGGKKESYYGIMKDSTTIDKMINTKNEKIEKNVELPKDANVSVKKEDFVMLFKDEKTGKITKVKKVNHDDVPHGLMSKIHDMGNMKHGM

SEQ ID NO: 3015 - protein, 703 aa, Staphylococcus epidermidis
YTMTCFLNIYKEYHSPPERNINRIILMFSLTNDLKITINGETKDLGNHIAIINQSDIYFINSASNLVLLSIPVIYFYSKDNKFFKCYFDRHLLQSSSFVKTIILQAIQHLIKGENQDEQSISKIIQTLLKEAVIRYKKKYIPQIAVNHSVFTEGLTFIHSKVSQSLSLREVAQHCNISESYCSNLFARYLNMNFKDYFTSLKVIDSIKRLLSSEDSINAISEQSGFSSHTNFTNQFKNYLGCSPKQYRTIISKLDSLPSISFSDTDFSQYIDLINQFEFSDHLATETTERDINEFYPQDQTKNSKAFIRFQNFNELFQFVFNEYYNIDFTSLPQAVIFINDITDISTREVNFNLLNRCFEKLFEKNIGLAMRLTSTNEFESIKEIILLFLNSHQDYKMNKKMVKFMLVFETKNMSVNDIHLCHLKIKNKNKAIRYSITVEGLLHQNSSIDRTYDMMKRLNFDYYFIDIENLETKNSLITKRKSYLHSSTHFENYKQFILDSGIPSTKFVYNNLSLKCFKYTNNGTYPLQLSDLVCHLVALMRYGGGVSYQLIEDESPFIALFNRYGSPLPLMHLYKLIEPFLNEPLEIANNFLMSRKDGNYHFLLFNKINDRYLSDSQQRYVFKNTLSTNSLIIIKTLNHEHGAIQNLLPQTKQQFYIERSILDELDKSNQPKTELAIQHDHHLPFQVTLKHDEVKYICFKPS

SEQ ID NO: 3016 - protein, 273 aa, Staphylococcus epidermidis
IYGKGELLPIIFFAVFFGLGLAAIGEKAEPVKGFLNGTLEAVFWMINKILKLAPIGVFAFICTTVMTFGASALIPLFKLLVVVVFAMVFFVIVVLGIVARMVGISIFSIMKILKSELLLAFSTSSSEAVLPIMMKKMERFGSPKDVTSFVIPIGYSFNLDGSALYQSIAALFVAQMYDIHLSLTEQLVLMATLMIASKGMAGVPGVSIVVLLTTLTSMNITAQGLALIIGIDRLLDMVRTCVNVIGNALSTVVIAKWENVYDKEKGQNYLNSI

SEQ ID NO: 3017 - protein, 155 aa, Staphylococcus epidermidis
IMCDKDIYNNKEMIILNKQQVTKAIEKVLNSSKIGVLSTAHHNKPNSRYMVFYNDDLNLYTKTNINSLKVEEIENNPDAHILLGYNETTNNSFVEIDATIEVVKNQKVIDWLWETQDKTFFNSKEDPELCVLKVIPRSIKLMNDDELDTPATIEL

SEQ ID NO: 3018 - protein, 176 aa, Staphylococcus epidermidis
RGVCIMALFKKKISVPTQVIIALVLGVIAGLLLYGQDDVANYIKPFGDVFLNLIKMIIIPIVFCSLALSISNLGDSKKVGSYGWKAILYFEIITTIAIGLGLIIGNLFKPGSGLDPDKLPKGDITKYQSSAHSAEQATTYGNHLIDTLVHIVPTNLFESMAKVSYYRLSFSQYFLD

SEQ ID NO: 3019 - protein, 125 aa, Staphylococcus epidermidis
LKERGKIEKLWREEKYRVLFHDQNAYHSIRTLLKSPTTLGEVKEHITHALTITPTKGSVINAFEHMWGYFKKQCTQYEKQHSRELKALYIENQIDYFELLSFLKNLADKYAVEYLQQSTILNITK

SEQ ID NO: 3020 - protein, 467 aa, Staphylococcus epidermidis
KKYQIAASLRLVDLWGTREAGFELPSLGLAGGLHTITRKESIMVNRQPPQGVIFGLPISLIWGFVAIAVFMTGDGIELAFLSRYVVDLGFSPTQATLLFTVYGFLAAISSWGSGVLAETFGPRRIMLIGVAAWIVFHVLFLIFGLEQQKYTLMVVFYGIRGLAYPLFIYAFMVWIAQVTPGARMASAMGWFWSMYCIGIGLLGNWIPSLSISRIGFINTLWVGVFWVAVAGLMIMYLVKERGAGKPDDAVTLVERLKTLSSGVTIIAERRGMFLIVLVRIICNLSLFGLPVILPLYLTSVEVGFSMEQWLHLWGVMFVVSIFTNVIWGQIGDRLGWLIQMRWFGCIGCALSSLAFYYLPQFYGAHFEIALIAAIGFGISVTAFVPMGAVFLALAPEQKGAAISAHNLAAGLSNFMGPGIATLFIATLGIKGVVWIYAGLYVAGAVLTFFIPVPQPRLCQLRHCPRYA

SEQ ID NO: 3021 - protein, 63 aa, Staphylococcus epidermidis
ATGHVPDCIGANYLQPEPVRSAGDPAAVPNLGRGRFQHGAMVAFVGCDVCGEHLHQRDLGANW

SEQ ID NO: 3022 - protein, 173 aa, Staphylococcus epidermidis
TGCRIPWSKVLSSAGVTGGMDLALALVEEDYGRELALSVAREMVMFFKRPGGQSQFSAQLAAQTAERSVIRDVQEYVVEHLKADLSVPALAARAGMSERNFARTFKAEAGSTPAEFVELARIDAARRLIEDADVSLKRLADTVGYANADGFRRAFMRRLGVGPSDYRKRFSLM

SEQ ID NO: 3023 - protein, 150 aa, Staphylococcus epidermidis
RYRVHPVARRIFGVPEPLGDLDMYTAKAGVLTFLPVGQSPGLDIQQVWCFDPVAQAWRVDMMIESGSPEVWVYKRDGSIRFPRTEMLYLSSEGIPYLRPAAILLFKALHVRPKDEEDFHKTLPTLPDEEVAWLKRHLLKLHPGHHWITPS

SEQ ID NO: 3024 - protein, 147 aa, Staphylococcus epidermidis
RSMKGLLQRVRGARVEVAGQVVGAIDQGLLVLVAVEPSDTAASADKLLHKLLNYRVFSDDEGKMNLSLKDIGGGLLLVSQFTLAADTKSGLRPSFSTAAPPALGEALFEHLLSQAQQLHGTVASGRFGADMQVHLVNDGPVTFLLQT

SEQ ID NO: 3025 - protein, 75 aa, Staphylococcus epidermidis
PAPNRQNRAEPVTSAFRNRLADNFGALQGLTITSNPRRKQIKKPTASYLYARLASIVPTPMGLNDSPRATGQVST

SEQ ID NO: 3026 - protein, 236 aa, Staphylococcus epidermidis
FGEDLERIREHLGIEKWVLFGGSWGSTLALAYAQTHPDRVLGLIVRGIFLARPQDIQWFYQAGASRLFPDYWQDYIAPIPVEERHDMISAYHKRLTGNDQIAQMHAAKAWSTWEGRMLGLCPSPQLIERFSEPQRALSIARIECHYFTNNSFLEPNQLIRDMHKIAHLPGIIVHGRYDMICPLDNAWELHQAWPNSELQVIREAGHAASEPGITDALVRAAGEMARRLLDLPPEEA

SEQ ID NO: 3027 - protein, 60 aa, Staphylococcus epidermidis
SRAWPDCARHLPGPPPGYPVVLPGRREPPVPGLLAGLHRANPGGRAPRHDQRLPQAPDWQ

SEQ ID NO: 3028 - protein, 74 aa, Staphylococcus epidermidis
QQVLKKRLAQRRWRRGGEAGTQAAFGIGCQGELGHQQQTTANVLQRQVHLALVVTEHPVVKQLMQQLVGTGGGI

SEQ ID NO: 3029 - protein, 68 aa, Staphylococcus epidermidis
SARRATRRPSRASPMRWCVRRARWHDACLICPLKKHEGPFATGAWRPGRGGGASGGRDRPGFAGTGGR

SEQ ID NO: 3030 - protein, 397 aa, Staphylococcus epidermidis
LAVGFLICFRRGLLVIVSPCNAPKLSAKRLRNALVTGSALFCLFGAGQLWAFSLDDVSAKAKELAGQKYEAPRSNLPNEFREMKFADYQKIRFRNEKAEWAEQKTPFKLSFYHQGMHFDTPVKINEITATDVQEIKYDPTRFDFGDVKFDPKATDQLGYAGFRVLYPINKDDKQDEIMTMLGASYFRVVGKDQVYGLSARGMAIDTALPSGEEFPRFTEFWIERPKPGDKHLVIFALLDSPRATGAYRLILRPGTDTIVDVKSQMFLRDKVSKLGVAPLTSMFLFGANQPSKVLNYRRELHDSSGLSIHAGNGEWIWRPLNNPKHLSVSNFSVENPRGFGLLQRGRNFSQYEDLDDKYDKRPSAWIEPEGDWGKGSVDLVEIPTADETKCSPAGRAE

SEQ ID NO: 3031 - protein, 87 aa, Staphylococcus epidermidis
SCRGALPPGLARCSPASSPGTGGSRRPGRTTGYPGGGPGRCRAQSGQARDQGGFVHRPGPGSSPRNHRTAPIFQSPGARECAQGLHQ

SEQ ID NO: 3032 - protein, 888 aa, Staphylococcus epidermidis
DGCSFYFLGGRHMEMKPKYDPREVEKGRYEEWVSNGYFKPSEDKSKEAYTIVIPPPNVTGKLHLGHAWDTTLQDIITRMKRMQGYDTLYLPGMDHAGIATQAKVEAKLNEQGISRHDLGREKFLQQAWDWKEEYATFIRQQWAKLGLGLDYSRERFTLDDGLSKAVRKVFVDLYNKGIIYRGERIINWDPIARTALSDIEVIHEDVQGAFYHFKYPYGDGNGYIEIATTRPETMLGDTAIVVNPNDERYKDVIGKTVILPIVGRELPILADEYVDIEFGSGAMKVTPAHDPNDFEIGQRHQLENIIVMDEYGKMNDKADKYKGMDRFDCRNQLVKDLKEQDLVIKIEEHTHSVGHSERSGAIVEPYLSTQWFVKMKPLAQRALDNQNTKDRIDFFPGRFENTFNRWMEEIRDWTISRQLWWGHQIPAWYHKDTGEVFVGEEAPEDIENWIQDEDVLDTWFSSALWPFSTLGWPDTNADDFKRYYPTNALVTGYDIIFFWVARMIFQGLEFTDRRPFNDVLLHGLVRAEDGRKMSKSLGNGVDPMDVIDEYGADSLRYFLATGSSPGHDLRYSTEKVESVWNFINKIWNAARFSLMNIGEDFKVEDIDLSGNLSLADQWILTRLNETISTVTELSDKYEFGEVGRALYNFIWDEFCDWYIEMSKIPMNGEDESQKQTTRSVLSYVLDKIMKMLHPFMPFVTETIWQSLPHHGETIVKANWPTVDQALIFNESKQTMEQLVEIIKSVRQSRVEVNTPLSKAIPILIQTKDEKIKHTLMDNISYLHKFCNPSQLTIDTEIEIPEKAMTTVVVAGKVVLPLEGLIDMDKEIARLEKELDKLQSELDRVDKKLSNENFVNKAPEKIINEEKEKQQHYQEKYNGVKSRIEQLKA

SEQ ID NO: 3033 - protein, 442 aa, Staphylococcus epidermidis
ISQSWRYLYMTATWEKKEGNEGVLTVTVPAEKVNKALDQAFKKVVKQINVPGFRKGKVPRPIFEQRFGVEALYQDAVDILLPEAYGEAIEDTEINPVAQPEVNVTQIEKGKDFIFEATVTVEPEVKLGDYKGLEIEKQETDLSDEELQESIDHSLSHLAEMVVKEDGAVENGDTVNIDFSGSVDGEEFDGGQAEGYDLEIGSGSFIPGFEEQIEGMKTGDEKDVVVTFPEEYHAEELAGKEATFKTKVNEIKFKDVPELNDEIANELDSDAENVDEYKENLRKRLSEQKATEAENTEKEEAINKATENASIDIPEAMINTELDRMIQEFGQRIQQQGLDLQTYYQISGQNEEQLRDQMKDDAEQRVKTNLTLTAIADEENIEVSDEDIDKELEKMSEQFNISVEDIKSTLGNTDIVKNDVRIQKVIDLLRDNAKYVEATKED

SEQ ID NO: 3034 - protein, 422 aa, Staphylococcus epidermidis
KRMFKFNEDEENLKCSFCGKDQDQVKKLVAGSGVYICNECIELCSEIVEEELAQNTSEGFTELPTPKEIMDHLNEYVIGQEKAKKSLAVAVYNHYKRIQQLGPNEDDVELQKSNIALIGPTGSGKTLLAQTLAKTLNVPFAIADATSLTEAGYVGDDVENILLRLIQAADFDIDKAEKGIIYVDEIDKIARKSENTSITRDVSGEGVQQALLKILEGTTASVPPQGGRKHPNQELIQIDTTNILFILGGAFDGIDEVIKRRLGEKVIGFASNEADKYDEEALLEQIRPEDLQSYGLIPEFIGRVPIVANLETLDVAALKNILTQPKNALVKQYTKMLELDNVELEFSEEALSAISEKAIERKTGARGLRSIIEEALIDIMYDVPSSENVSKVVITEQTINEEIEPELYDDEGNLINKNKTSA

SEQ ID NO: 3035 - protein, 110 aa, Staphylococcus epidermidis
DTNFSHIEVFWVLKFFRNNKLIVVLCAMIIFIALIGLSIRSQTQSPAEQYVGDSVSFGQRVISYPIQFVTGSIGDLFEKGSSKKDKNKIKQLEAKNEELESANKKYNNRT

SEQ ID NO: 3036 - protein, 107 aa, Staphylococcus epidermidis
SNHYLPIPHNDPFQLLLDHILVSFPYVYLLKNKKNIHPIKNRTDVLFRGTTYIQEEIIHSFLQALKSLINAHTRLLPTCRLCFNRSYKIGLPSDLIIYIFTATICSL

SEQ ID NO: 3037 - protein, 73 aa, Staphylococcus epidermidis
YYIYNISDLRRFNIMSILTIILIVLLVILLFKVGLSILRFLISVGIVLLCIYLGYQGVLWLFEHFQNFSGFIR

SEQ ID NO: 3038 - protein, 126 aa, Staphylococcus epidermidis
RSSKEEFIMPRVKGGTVTRARRKKTIKLAKGYFGSKHTLYKVAKQQVMKSGQYAFRDRRQRKRDFRKLWITRINAAARQHDISYSRLMNGLKKAEIDINRKMLSEIAISDDKAFAELVSKAKEALK

SEQ ID NO: 3039 - protein, 309 aa, Staphylococcus epidermidis
RMRKLIVGSRRSKLALTQSQQFIDKLKFIDPSLDIEIKEIVTKGDKIVDKQLSKVGGKGLFVKEIQNELFNKEIDMAIHSLKDVPSMIPDGLTLGCIPDREIPFDAYIAKNHIPLQELSEGSIVGTSSLRRGAQILSKYPHLKIKWIRGNIDTRLKKLETEDYDAIILAAAGLKRMGWSDNIVTTYLDRDILLPAIGQGALGIECRSDDKELLDLLSKVHNHDVAQCVTAERTFLSEMDGSCQVPIGGYATIAQDNQIEFTGLIMSPDGKERYEHTALGTDPVKLGIEVSQVLKKQGAYDIIKKLNEAE

SEQ ID NO: 3040 - protein, 173 aa, Staphylococcus epidermidis
IILNLICKRRAYMRYIFSVIKNIIAVLAIILIIYIALQHAPFLKNQEWNPLNDMNNHHQNITQKVSQKNNTLYSQPSNDKSYILKENDIINNVPAGQIKTVFNMIDKAEFMSVSGLERMGFNDEYLAGQQGDEFIIYKFGDDYIRVYNTEFEMNEDLNQLKQPINLKPIEAYQ

SEQ ID NO: 3041 - protein, 77 aa, Staphylococcus epidermidis
ILVKRPIGNESCLGMKTHRGAAKRVKRTGSGQLKRSRAFTSHLFANKNTKQKRQLRKAKLVSKSDMKRVKQLLAYKK

SEQ ID NO: 3042 - protein, 61 aa, Staphylococcus epidermidis
KVGNKMKFDRHRRLRSSKTMRDLVRETHVRKEDLIYPIFVVEQDDIKSEIKSLPGIYQISF

SEQ ID NO: 3043 - protein, 161 aa, Staphylococcus epidermidis
SKYEVKRRGDMEDDPSFKQLISYCLLENEKGEILIYERLSGGGEERLHGQSSIGVGGHMNDVVGADSINEVLRVNAQRELEEEVGLSNNKSQNMEYLGFINDDDNDVGKVHMGVVFKITVHSNDVEAKETDTLKIKWIEQGDIQSYEDFETWSALILQDIS

SEQ ID NO: 3044 - protein, 274 aa, Staphylococcus epidermidis
FGDDMQETLLIRFHEIILMIYLFSIICYFVDFINKNYKTRTVGFYSLGIVWVLQTISLSIFFIHTKQVPLGSIFDVFFSLTWIIISISLILNLIKVMNFSVFFLNLIGFILMSLNTFQPEHYQTQIQQIAVINELLLVHIALAVLSYAFFAIAFVNSLLYIIQYRNLKEKNFDQNYFRIGSVATLETIVFYSTLVAWIILILSTILGAQWGIFAVGKQIFIDPKVIFSTIITLLYGVYIFIRIKKWISQRNLIYFNIILFCLCMINLFFLTHFR

SEQ ID NO: 3045 - protein, 87 aa, Staphylococcus epidermidis
SSALVELITMSVVSNKDGNAESESYETLCFSAKILALDNVRLTIVTFEIPEPKRFKSDNSPISPAPITTACLLFNFPNTFLANSTAA

SEQ ID NO: 3046 - protein, 208 aa, Staphylococcus epidermidis
YIILLIYIIMDIKISQCIGDEIMNECAFNTTDPIYIEYHDYYWGQPIYDSKELFKLMALESQHAGLSWLTILKKKESYEQAFYNFEPQFIAHMTEQDIDYLMKFPNIIHNRKKLEAIVSQAKGYLKIEKDYGSFSKFLWSYVNHQPINMGYKKPRDRKKVDQRATQLSKDLKAYGFKFLGPVTVFSFLEAAGLYDSHLEGCPFKPNHE

SEQ ID NO: 3047 - protein, 205 aa, Staphylococcus epidermidis
LYNSIRKRKSMNINFNNINLIISAVKKAQYPDTGLTEVALSGRSNVGKSTFINSMIGRKNMARTSQQPGKTQTLNFYNIDEQLIFVDVPGYGYAKVSKVQREKFGKMIEEYITQRENLKLVIQLVDLRHQPTEDDVLMYNYLKHFDIPTLVICTKEDKIAKGKVQKHIKRIKDKLELESGDNIISYSSIKNSKQQEIWNFIETYI

SEQ ID NO: 3048 - protein, 358 aa, Staphylococcus epidermidis
SGILKRNFINNLIILLIAIMLSLLLKMLHVILPFMFGPILAALLCVKVLKLKIRWPFWLSQIGLILLGVQIGSTFTQQVIKDISKNWLTIVFVTILLILLALIIAFFFKKIAQVNLETAILSVIPGALSQMLVMAEENKKANILVVSLTQTSRVIFVVILVPLISYFFQDNHHEMNHTTMEVPTLSQTLNIWQIIILFSMVGIIYIGMSKINFPTKQLLAPIIVLIIWNMTTHLTFSLDHWLLATAQLIYMIRIGLQIANLMSDLKGRIAIAIAFQNIMLIVTTFIMIIGIHLITNESINELFLGAAPGGMSQIVLVAMATGADVAMISSYHIFRIFFILFVIAPLIGYFINVKLNNK

SEQ ID NO: 3049 - protein, 427 aa, Staphylococcus epidermidis
RHRSMIMNYLDSLYWIHERSKFGIKPGVKRMEWMLEQLNNPQHKIRGIHVGGTNGKGSTVAYLRTALIENDYSVGTFTSPFIESFNERISLNGVPIMNDEIVQLVERVKPVSEALEIETDLGGATEFEIITTMMFLYFGEINPVDFVIIEAGLGIKNDSTNVFKPVLSILTSIGLDHTDILGTTYLDIAKDKAAIIKPHIPIVYAVKNDDALKYVRDYALEQNAKPIELDREITVVSQDDEFTYRYKDYELETIILNMLGEHQKENAALAITALIELNERQIIELDFNKMIDGIESVNWTGRIEQVKEQPLMVIDGAHNNRSIDALVDTIRHYYGRDKIDILFSAIKGKPIHSMINKLNDIASKFYIADFEFPKALAKEEIAEELKLDNLHLIDDYVDFIENYEGDGLIITGSLYFISEVKAKINFN

SEQ ID NO: 3050 - protein, 229 aa, Staphylococcus epidermidis
NKFMKPVIVMTQTNEVHSHLVDIIHKPFIQLKQLHFNEKLLDHSYDWLIFSSKNAVKYFYPYLKNVKVKKVAVIGDKTAQYCNELGISVDFVPRDFSQEGFLDEFKISEQHLLLPSSEKARSKLVQQLSKYNEVVKIDLYRPVPNFKNISQVKSLVRKHQIDAVTFSSSSAVEFYFKEDNVPEFDHYFAIGKQTARTILKFNTSVKVANKQTLDSLIDKIIESREQNEI

SEQ ID NO: 3051 - protein, 431 aa, Staphylococcus epidermidis
GGHMMSFEKSIKAMEQAEKLMPGGVNSPVRAFKSVDTPAIFMDHGEGSKIYDIDGNEYIDYVLSWGPLILGHKNQQVISKLHEAVDKGTSFGASTLQENKLAELVIDRVPSIEKVRMVSSGTEATLDTLRLARGYTGRNKIIKFEGCYHGHSDSLLIKAGSGVATLGLPDSPGVPEGIAKNTITVPYNDLDSLKLAFEKYGDDIAGVIVEPVAGNMGVVPPVNGFLQGLRDITNEYGALLIFDEVMTGFRVGYNCAQGYFGVTPDLTCLGKVIGGGLPVGAFGGKKEIMDYIAPVGTIYQAGTLSGNPLAMTSGYETLSQLTPESYEYFNSLGDILEKGLKEVFAKHNVPITVNRAGSMIGYFLNEGPVTNFEEANKSDLKLFSNMYREMAKEGVFLPPSQFEGTFLSTAHTKDDIEKTIQAFDNALSRIV

SEQ ID NO: 3052 - protein, 98 aa, Staphylococcus epidermidis
ADVLFLLIRFPSSSYNSGSISSLIVCSVMTTLLTFSEEGTSYMMSINASSIIERNPRAPVLRSIAFSLIADRASSENSNSTLSNSSILVYCLTSAFLG

SEQ ID NO: 3053 - protein, 222 aa, Staphylococcus epidermidis
IFTFNTIYILIIRSNFISLSPTFISFKGRILLRINEMALHEKPRERLITYGAKSLSNVELLAILLNTGRKGFSSIDIANELLKQQSTIRDLKKLSINDLLKIKGIGLYKAVILQAAFELGERINSTSTFDKVQITHPSDVASLMMSTMKDLEQEHFVVLLLNSKNIVTKQAWVYKGTLNSSIIHPREVFNIAIRESSNSIIVVHNHPSGDVTPSERGYEYNV

SEQ ID NO: 3054 - protein, 319 aa, Staphylococcus epidermidis
FFKIYHDWSAKLMADIIPFPQFKSKMIKQINDAERNADFEKMYQLFNVYEQHFDPNEEIALKKCQMLLQLNAYLELREEAIILLKRGFNCYDELMIYYIKSLNGLGQFNEAVEVINQIIDEVKNHKTRMELFPLKEYAISRLDEDRKALSSSLSDFGSLNTREQTSLILQLIDNGHYNFKESVANILISMDLPKNLVSLMLEYLRFAEYSHTITIHKYGETINVNPNHLSGIEHTTIKDKVIPVVMNRLEDGALHILKEAQHIMNNHSILMYPIDIESLYTIDNWIDAYDVYFKQLIGIDINGCNNDTLQFIKSLDNEM

SEQ ID NO: 3055 - protein, 448 aa, Staphylococcus epidermidis
MHFVAISINHRTADVTLREQVAFRDDALRLAHEDLYETKAILENVILSTCNRTEVYAIVDQVHTGRYYIQRFLARSFGFEVDDIKDMSEVKVGDDAVEHLLRVTSGLDSIVLGETQILGQMRDAFFLAQNTGTTGTIFNHLFKQAITFAKKAHSETDIADNAVSVSYAAVELAKKVFGKLKSKHAVVIGAGEMGELSLLNLLGSGISNVTIVNRTLSKAKILAEKHNVSYDSLSALPSLLETTDIVISSTSAEDYIITNSMVKTISETRKLDSLVLIDIAVPRDIEPGIDAITNIFNYDVDDLKDLVDANLRERQLAAETIAGQIPEEIDSHNEWVNMLGVVPVIRALREKAMNIQAETMESIDRKLPDLSERERKVISKHTKSIINQMLKDPIKQAKELSTDKKSNEKLELFQNIFDIEAEDPREKAKLEKESRAKEILAHRIFSFE

SEQ ID NO: 3056 - protein, 72 aa, Staphylococcus epidermidis
TDEVTTNDKNINGIKGKYLISLKEKIFKIMAKIPPMINVNTTIKKKKFNGNISPNILKSNMSPYPINLDANR

SEQ ID NO: 3057 - protein, 237 aa, Staphylococcus epidermidis
YMLLLAYTCSIIFSFLYQFCNQNILKLQYLYSRSHCDFCHTIIKPLDLLPIISFLKLRGQSRCCNQPLQRLYLIGELVSFGAIFLYYPTHFNIHFTLFLITFLFLLTMCLYDIHSMHIDMRLLFVYTVVSVFTTQTYFGNFIMIFLISHVIYLFASKFIGYGDILLFNILGLIFPLNFFFFIVVFTFIIGGIFAIILKIFSFKDIKYLPLIPFIFLSFVVTSSVYHQLLFLLRGEFY

SEQ ID NO: 3058 - protein, 98 aa, Staphylococcus epidermidis
VKIFLSAATSKVSRLATIGTRPINSGIKPYDWRSSGRICSSKASSSYLSASLLANPITFSPKRLLMTSSIPSKAPPKINKMFVVSIWINSWFGCFRPP

SEQ ID NO: 3059 - protein, 286 aa, Staphylococcus epidermidis
KVKLNHYQAYTKLVFKKKILLHEEIKEAYDLGIRAIMFFGVPNDKDDIGSGAYDHNGVVQEATRISKNLYKDLLIVADTCLCEYTDHGHCGVIDDHTHDVDNDKSLPLLVKTAISQVEAGADIIAPSNMMDGFVAEIREGLDQAGYQNIPIMSYGIKYASSFFGPFRDAADSAPSFGDRKTYQMDPANRLEALRELESDLKEGCDMMIVKPSLSYLDIIRDVKNNTNVPVVANNVSGEYSMTKAAALNGWIDEEKIVMEQMISMKRAGADLIITYFAKDICRYLDK

SEQ ID NO: 3060 - protein, 116 aa, Staphylococcus epidermidis
LPVTNRRKVGMTSNHHAPYDLGYTRATMDNTKGSETARSSKSHKVVLSSDCSLQLDYMKLESLVIVDQHATVNTFPGLVHTARHTTRVCNTRSRWSNHLELAVEGGTNDWGEVVTR

SEQ ID NO: 3061 - protein, 614 aa, Staphylococcus epidermidis
RERLMKWLKQLQSLHTKLVIVYVLLIIIGMQIIGLYFTNSLEKELLDNFKKNITQYAKQLDVNIEKVYKDKDKGSVNAQKDIQDLLNEYANRQEIGEIRFIDKDQIIMATTKQSNRGLINQKVNDGSVQKALSLGQTNDHMVLKDYGSGKERVWVYNIPVKVDKQTIGDIYIESKINDVYNQLNNINQIFIVGTAISLFITVILGFFIARTITKPITDMRNQTVEMSKGNYTQRVKIYGNDEIGELALAFNNLSKRVQEAQANTESEKRRLDSVITHMSDGILATDRRGRVRIANDMALKMLGLAKEDVIGYYMLGVLNLENEFSLEEIQENSDSFLLDINEEEGIIARVNFSTIVQETGFVTGYIAVLHDVTEQQQVERERREFVANVSHELRTPLTSMNSYIEALEEGAWQDKELAPSFLSVTREETERMIRLVNDLLQLSKMDNESDQITKEIIDFNMFINKIINRHEMAAKDTTFVREIPQQTIFAEIDPDKMTQVFDNVITNAMKYSRGEKRVEFHVKQNALYNRMTIRIKDNGIGIPINKVDKIFDRFYRVDKARTRKMGGTGLGLAISKEIVEAHNGRIWANSVEGQGTSIFITLPCEIIEDGDWDE

SEQ ID NO: 3062 - protein, 263 aa, Staphylococcus epidermidis
MNWKLTKTLFIFVFILVNIFLVIVYIDKVNKSQVNDSEKVNEVNFQQEEIDVPKDVLNQSVKDTELEQITARSKNFSSYAKDHSSLQTSDSDKTLEGDIDKGVQVSDKNLQDIKEYIAKKIFNGKEYQLSDLTKDKVTYEQTYKDYPIMNNSKARLTFNLSDGKATSYKQTAMDDIQVAKGSNSTKKQVITPRKAIEALYYNRYLKQNDQVLDARLGYYSVVKETNVQLLQPNWEIKVKHKGKDEVQTYYVEATNHNPKVIDY

SEQ ID NO: 3063 - protein, 234 aa, Staphylococcus epidermidis
YMARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQEVSGATNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHD

SEQ ID NO: 3064 - protein, 268 aa, Staphylococcus epidermidis
ERMSRLIRMSVLASGSTGNATYVESEKGSLLVDVGLTGKKMEELFSQIDRNIKDLNGILVTHEHIDHIKGLGVLARKYKLPIYANENTWKAIEKKDSRIPMDQKFIFNPYETKSLAGFDIESFNVSHDAIDPQFYIFHNNYKKFTMITDTGYVSDRMKGMIQGSDVFMFESNHDVDMLRMCRYPWKTKQRILSDMGHVSNEDAGLAMSDVITGNTKRIYLSHLSQDNNMKDLARMSVGQVLNEHDIDTEKEVLLCDTDKAQATPIYTL

SEQ ID NO: 3065 - protein, 63 aa, Staphylococcus epidermidis
KLNIPIHAYISIIKNTVITALLTYTKTIKYDDKPKQKRQAYCKSLTYFAELYFNGKIINNIIL

SEQ ID NO: 3066 - protein, 466 aa, Staphylococcus epidermidis
KDKVRQSLLRFLAKSLKTVIGMNNKEHTKSIILVLLVLMSIVLTYMVWNFSPDLSNIDNTDNSKSDKPKPLTKPMTAEMEGTITPFQIVHSRDDKSQGTVASGAVLDKMIQPLKNQEVKSVSHLKREHNLVIPELSNDFIVLDFTYDLPLSTYLSQVLDIDAKVPNNFNFDRLLIDQDHNNHVVLFAISKDRHEVVKLKTTMKGNNVDKAFKSIEPDMQPYTEIITNKDTIDKATHVFAPSKPKDLKTYRMVFNTISVERMNSILFDDSTIVRSSQSGTTTYNNNTGVANYNDKDEMYHYKNLSEDAKSSSNMQETIPGTYEFINSHGGFLNEDYRLFKTDNRTGKLTYQRFLNGYPTFNKQNFNEIQVTWGDKGVYDYQRSLLKTDVTLNSEESKSVPTVESVRSALANHPDIDFEKVTNIAIGYDMDDKANNEDIEVQRNCELIPRWFVEYDGNWYAYKDGRLE

SEQ ID NO: 3067 - protein, 846 aa, Staphylococcus epidermidis
FIPWGTSNGRNPCEKKREFDPNLAPGTEKVVQKGEPGTKTITTPTTKNPLTGEKVGEGEPTEKITKQPVDEIVHYGGEQIPQGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGE

SEQ ID NO: 3068 - protein, 383 aa, Staphylococcus epidermidis
IKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEITEYGGE

SEQ ID NO: 3069 - protein, 135 aa, Staphylococcus epidermidis
IKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEKIQHGPKV

SEQ ID NO: 3070 - protein, 99 aa, Staphylococcus epidermidis
GSIPPTPPRKLALTFQRLLPILYKLCRISISGYSKAPRGLSVLSRVTCIFTGTMISPSLSLRQCPNRYAFRAGRNLPDKEFRYLRTVIVTAAVYWGFDS

SEQ ID NO: 3071 - protein, 100 aa, Staphylococcus epidermidis
RLPPTYYRGCWHVVSRGFLIRYRQDVHSYLHICSSLITEFYDPKTFITHAALLRQAFAHCGRFPTAASRRSLDRVSVPVWPITLSGRLRIVALVSRYLTN

SEQ ID NO: 3072 - protein, 97 aa, Staphylococcus epidermidis
GSLTARPTSRAGSKDGLSDPVVPHGRAIAQRIKATPGITGLSPPRVHIDGEVWHLDVGSSHPGAVVGPKGWAVRPLKRYASWVQNVVRQFGPYPSWA

SEQ ID NO: 3073 - protein, 116 aa, Staphylococcus epidermidis; identical to SEQ ID NO: 3060

SEQ ID NO: 3074 - protein, 74 aa, Staphylococcus epidermidis
ANILVVWATPHPFPLNIYFGTLAGGLGCFPFEHGPYHPCSDSQVKLIGIRSLSEFGNPRGAPRPNSALPPIIIT

SEQ ID NO: 3075 - protein, 74 aa, Staphylococcus epidermidis
AHGFKFSFTPLPGYFSPFPHGTGSLSVTREYLALGDGPPRFRRNFTCSVVLRIHSRENMFPTTGLLPSLIHLSR

SEQ ID NO: 3076 - protein, 68 aa, Staphylococcus epidermidis
LCWLSNPHHLSWWETVSGGQFDWGGRLLKGNGGAQRFPQNGWKSFIECKGIRELDCETYKSSRVERRT

SEQ ID NO: 3077 - protein, 121 aa, Staphylococcus epidermidis
IISTEKYSKEKHTLFLISSHQLKELEDLCDRFLLLENHQIREIDLHNRIFTQKLIFKNTLNNAPELKANFNFIKKIDSNSITIINKDEEVDLTNLLNLVGKNPLIKIESNDNLLSSYFYKE

SEQ ID NO: 3078 - protein, 137 aa, Staphylococcus epidermidis
RVGNIMFKFNFFYISKIRATWMLYLIGIYPLLIFLAELLNSNFLSLSATHKNSVSFLELFIAIYDTQQKVMLSLIIIGYLSSLLFYSEISTGRLLFYKDQSRYKIFNSKLTSIISSYFIFFFILLLSTWLLTAECPH

SEQ ID NO: 3079 - protein, 84 aa, Staphylococcus epidermidis
MVNFKIEKLKLNNLFISLSIVIITTIVLNISIGIISYLKLSEYCEFLSMILSLIISFIIIPTFLSSIFNYKTNPFKLLTIKNLL

SEQ ID NO: 3080 - protein, 209 aa, Staphylococcus epidermidis
HLRYNISRIFGVLVGIPVAFIVWLITVFALDLSFIIDMLISFGSFIASYFPTQRLTSRKYLNEIGLSRRDYRYVQSQLHHAHTKIRNILKSFINIRSIKDFRQVNDIYRISRSIHTSIKQRPAMFFKVESFFYSHLDNALNLVDSYTRLARMPRKSQDEKLKLEQTRITLDEIKRTLIADLKRLNEEDYERLDVEIELNKLEQQRRHNN

SEQ ID NO: 3081 - protein, 79 aa, Staphylococcus epidermidis
CILKEFSLGGFRIMKQGTVKWFNAEKGFGFIEVEGENDVFVHFSAINQEGYKSLEEGQSVEFEVVEGDRGPQAANVVKL

SEQ ID NO: 3082 - protein, 69 aa, Staphylococcus epidermidis
LNIEERKVGIIIKLIIRERIIDKNSQYSDNLRYDIIPMLIFSTIVVIITILSDMNKLFSFNFSILKFTI

SEQ ID NO: 3083 - protein, 75 aa, Staphylococcus epidermidis
VIIEKLSLNLYLITYKIILEGNLINRLDSNDSLRCKIKANSKEPIEIEVNKLKLFSKMLNTTSLNKISSPKAIKK

SEQ ID NO: 3084 - protein, 111 aa, Staphylococcus epidermidis
LYSREGEINMWTVVKIRADYEGWWLFEDWPQKIVEQSEFTTYDQMLDYYINVLNHSKKCYDNYVVGKYNIHAFYNNCDLNFCEDCEEDLQIFYSFIILKNNEVYFNLPKID

SEQ ID NO: 3085 - protein, 433 aa, Staphylococcus epidermidis
MFFGAGNLIFPTQLGLESGHFFWPAILAFALTGIGLPLLGVVVGALDKHGYIGSFNKISPRFSLIFLIIIYLTIGPLFAIPRTASTSFEMTVTPIAHNSGNLALFIFTVIYFLIVLYLCLNPNKMIDRIGSLLTPLLLITIVAMIIKGFVDFSGHSSNYGMTNAYHSNLSGFSQGFTQGYLTMDAIASIAFSMIVVNAIKTTGIQHADKIFKQTIIAGLIAAIALVFIYISLGYIGNHINIPSDTLKELKAKDQNIGTYLLTTMATKGFGTFGKYLLGIIVSLACLTTACGLIVSVSEYFHRILPKIPYKVFVIFFILVSFILANQGLNSVIKMSVPVLSVIYPVAITVILLILIARFIPTKRIAQQIPLIIVAIESILSLITTQGWIRISFIDGLPLKEYSLEWFPIAVVATLVGYMISYFVKQSNIVYQKE

SEQ ID NO: 3086 - protein, 108 aa, Staphylococcus epidermidis
YFIILLILIVYVDDYKLIIFYFFIALGEEILFREVVFNILLNNFSLLTSISIGSLLFALILHLNESLESNLLIRFPSSIILYVIRYKFKLSFSIITHWIYNIFIVVMR

SEQ ID NO: 3087 - protein, 104 aa, Staphylococcus epidermidis
FFTIKIRIIKTRGDFMQRKHIQVFGTVQGVGFRFYTQRIAHQFNIKGTVQNVEDYVDIYAQGDDTELEQFIDSVIQGASPASQVSNYNIEELDLDESLSEFKTI

SEQ ID NO: 3088 - protein, 392 aa, Staphylococcus epidermidis
NSNVDIIINRNGEMSEMVSERSSNQSHPLDYYMNNQSTDHHTIAEDLEIQLTENDKQRIKSISEQIEPLNHEGLLKYGANLQQKMSHFSHQILDDVQSKDMGPVGETLSQLMGKLKSVNPNDINPEKQSRLKRLFKRTKASINEVFSRMQSVSSQIDRITIQLEKHKDQLTKDVEFLDQLYQQNKTYFDNVTLYILAAQKKKKEILTETIPQLREKAHQTGNQMDIQATADMEQFVDRLDKRIYDLQLSRQIAIQTAPQIRMIQNVNQALAEKIQSSILTSIPLWKNQMAIALTLMRQRNTVSAQRSVTDTTNELLTPNASMLKENAIETAAENERGIVDIETLKTTQNDIIETIEQTLQIQEDGRQKRQVAEKELNELEQDLKQHLLAMRK

SEQ ID NO: 3089 - protein, 114 aa, Staphylococcus epidermidis
RSLSKPIERYEYKMTNMVIIILVMMSRALKISTTNTMLYGAFQEPSSTLIGPSRSTFFKLINAMTNVSNVPTSATYLFIIGRFPINMSKIAVRIGMTKVKTSKLLSIIFWRSFH

SEQ ID NO: 3090 - protein, 128 aa, Staphylococcus epidermidis
YRMLYRFSHKTGVYGVSVKEETGNQILVQIEQVIKHPKQGDLHHPNETEGVFFHERKALSHFEKRYATPSQLRDFNVEAMPYEDSLQHAITHLENQLKKEKTEYSRLSLNNLNRLKEDYAIQYKRHFD

SEQ ID NO: 3091 - protein, 97 aa, Staphylococcus epidermidis
TKLTRCLMYKDYNMTQLTLPMETSVLIPTNDISRHVNDIIETIPETEFDEFRHHRGATSYHPKMMLKVVLYAYTQSVFSGRKIEKLLNDNIRMMWLS

SEQ ID NO: 3092 - protein, 451 aa, Staphylococcus epidermidis
VLITGGNKMTHIQLDYGKTLEFFDKHELDQQKDIVKTIHQTIHKGTGAGNDFLGWLDLPVDYDKEEFSRIVEASKRIKSNSDVLVVIGIGGSYLGARAAIEMLTSSFRTNTEYPEIVFVGNHLSSSYTKELLDYLQGKDFSVNVISKSGTTTEPAVAFRLFKQLVEEKYGKDEAKKRIYATTDKSKGALKQLADNEGYETFVVPDDVGGRYSVLTAVGLLPIATAGINIESIMIGAAKAREELSSDDLDQNIAYQYATIRNILYSKGYTTEMLINYEPSMQYFNEWWKQLYGESEGKDFKGIYPSSANYTTDLHSLGQYVQEGRRFLFETVVKVNHPKHDIKIEEDADDLDGLNYLAGKSIDEVNTKAFEGTLLAHTDGGVPNIVVNIPQLDEETFGYVVYFFELACAMSGYQLGVNPFNQPGVEAYKQNMFALLGKPGFEDKKKELENRL

SEQ ID NO: 3093 - protein, 92 aa, Staphylococcus epidermidis
VVKTFANIPIIASLFIPFGASIGLDTMALIALIGTASALGDSGSPASDSTLGPTAGLNIDGQHDHIRDTCIPNFLFYNVPLMIFGTIAAMVL

SEQ ID NO: 3094 - protein, 70 aa, Staphylococcus epidermidis
KLSQASPKLWFNWSRISKTSTKSRKSIIKRQRIKIVIKNNSHLKLQKFNFVLSYQSLYKKNVKFPFILSN

SEQ ID NO: 3095 - protein, 66 aa, Staphylococcus epidermidis
CGYHKIKSLLIKRLIDSKTNKKIMKNYSWEYFNVQINQKLSERKAKTIYSQRKIDVESVFGIMKLF

SEQ ID NO: 3096 - protein, 503 aa, Staphylococcus epidermidis
KERQKMIESNLLVLTLVIPILTAILLIFIGKRPIIKRYVALVGTLLTLVIALINLKNVLRDGPIKVELGSWKAPYSIVFVVDIFSALLIITSIIITILVILYSYRSIGLDRERHYYYFSIMFMLIGIIGSFTTGDIFNLFVFFEVFLMSSYCLLVIGTTKIQLQETIKYILVNVVSSSFFVMGVAVLYSVVGTLNLAHISERLSQLSVHDSGLVNIVFILFIFVFATKAGVFPMYVWLPGAYYAPPVAIITFFGALLTKVGVYAIARTLSLFFNNTVSFSHYVILFLALLTIIFGCIGAIAYYDTKKIILYNIMIAVGVILVGIAMMNESGMTGAIYYTLHDMLVKASLFLLIGVMYKITKTTDLRHFGGLIKGYPILGWTFFIAALSLAGIPPFSGFYGKFYIVRATFEKGFYLSGIIVLLSSLIVLYSVIRIFLKGFFGEVEGYTLSKKVNVKYLTTIAVASTVITVIFGLSADTLFPIIKDGAETFVDPSQYIHSVLGGK

SEQ ID NO: 3097 - protein, 87 aa, Staphylococcus epidermidis
NMKHLIKYLISFTFAIIIVIFIQSFIIVGAVISNNSMTPTLQTGDRVIVNKIKVTFDLIQRGDIIMYRHNNKTYFSRIVGNSHNHGM

SEQ ID NO: 3098 - protein, 80 aa, Staphylococcus epidermidis
ARFKVPTTEYKTATPMTKKDDETTLTKIYLIVSCNCILVVPITSKQYEDIKKTSKNTNKLKISPVVNEPIIPININMIEK

SEQ ID NO: 3099 - protein, 200 aa, Staphylococcus epidermidis
YNPKKGFDVLSLSQLEEWFDAFRQFGYIPGFIMLYLRAIVPVLPLTLYVVLLIHAYGLFPGIIISWLGIVSGTFTVFLICKKFVNTIRMKKLKSRKSVQRLISFIDRQGLIPLFVLLCFPFTPNTLINIIASLSHIKIKYYFFVLVISKLISITILGVMGKEIFTIFTNPLRALIMIVLLVVLWFISKKVEKHFMGSTKE

SEQ ID NO: 3100 - protein, 130 aa, Staphylococcus epidermidis
GVIKLNHHYKVGQHIKVRVTGIQPYGAFVETPDHTEGLIHISEIMDDYVHNLKKFLSEGQVVKAKILSIDDEGKLNLSLKDNDYFKNYERKKEKQSVLDEIRETEKYGFQTLKERLPVWIKQSKRAIHND

SEQ ID NO: 3101 - protein, 125 aa, Staphylococcus epidermidis
TMTNLLETFEMKIEQKEDGKVVVSMPVTDKVKQPFGYLHGGASLALGETACSIGAAHLIDTQQFIPLGLEMNANHIRSTRQGHVRAFASLIHQGKTTQVWNIDIKDDHDQLISVMRGTIAIKPIQ

SEQ ID NO: 3102 - protein, 144 aa, Staphylococcus epidermidis
MTMNRQQNNLIFQYAAVIIFFMVIVFGFSLFLAGHYTPGGGFVGGLLFASALLVITIAYDVKTMRKIFPLDFKILIGIGLLFCVGTPLTSWFMSKNFFTHVTFDIPLPLLEPMHMTTAMFFDFGVLCAVVRTIMTIIISIGENE

SEQ ID NO: 3103 - protein, 420 aa, Staphylococcus epidermidis
KEANRIMTENNNLVTSTQGIIKEALHKLGFDDGMYDLIKEPIRFLQVRIPVRMDDGTVKTFTGYRAQHNDAVGPTKGGVRFHPEVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSQGRDRSTALGVVIAIEQAAKRRGMDIKDAKIVIQGFGNAGSFLAKFLYDLGAKVVGISDAYGALHDPNGLDIDYLLDRRDSFGTVTNLFEDTISNKELFELDCDILVPAAISNQITEDNAHDIKASIVVEAANGPTTPEATRILTERDILLVPDVLASAGGVTVSYFEWVQNNQGYYWTEEEVNDKLREKLVTAFDTIYELSQNRKIDMRLAAYIVGIKRTAEAARYRGWA

SEQ ID NO: 3104 - protein, 61 aa, Staphylococcus epidermidis
FILDGIFVCCCIDFSDWFGAGEWFEVSAIEGELKLAKPSVTVDKVEMIIFLDLNIKTSFQK

SEQ ID NO: 3105 - protein, 808 aa, Staphylococcus epidermidis
ILKEENIVSLLHIAVLLPLIFALIIPFLYRFVKRIHLGWFVLPVPIVLFIYFISLISMTMSGNNVMKNLNWMPHIGMNFNLYVDGLGLLFSLLITGIGSLVVLYSIGYLSKSEQLGNFYCYLLLFMGAMLGVVLSDNFIILYLFWELTSFSSFLLISFWREKKASIYGAQKSLIITVLGGLSMLGGIILLSLATDTFSIQAMISKASDIQNSPFFILVMILFMIGAFTKSAQVPFYIWLPDAMEAPTPVSAYLHSATMVKAGLYLIARITPIFAISEGWVWTITLVGLITLFWASLNATKQHDLKGILAFSTVSQLGMIMSMLGIGAVSYHYQGANSQLYVAGFVAAIFHLINHATFKGALFMITGGIDHSTGTRDVKKLGGLLTIMPISFTLTVITTLSMAGVPPFNGFLSKEKFLESMINVTHLNLMSLNTLGILLPIIAIIGSIFTFVYSIKFILHIFFGSYKPEALPKQAHESSILMLISPIILTSLVIVFGLFPSILTQSIIEPASVAVSQTSNITAEFHLFHGITPAFLSTIGIYIIGILLLISFSYWVRLLQAHPYQLTLNHWYDTSGQRIPGYSENITNSYVTGFSRNNLVIILGILIALTFVTVISVPFSIDFKNVSHLRVFEGATVLFLLIASTFIIFAKSRLFSIIMLSAVGYAISVLFIFFKAPDLALTQFVVESISTALFLLCFYHLPNLNRYNEKPTFKLTNAVISIGVGLSVIILGLIGYGNRHFDSITKFYQEHVFDLAHGKNMVNVILVNFRGMDTLFESSVLSIAGLGVYTMIKLRLKQKNQSSEVNDHE

SEQ ID NO: 3106 - protein, 62 aa, Staphylococcus epidermidis
CGVCFWNYEAILSFTRKSVRGINKDKRELGLVLMTLNIRKVPAQRAENYKKIIKKTIFILFQ

SEQ ID NO: 3107 - protein, 406 aa, Staphylococcus epidermidis
VFIRKRRGDFMTQSEKIINLTNHYGAHNYVPLPIVISEAEGVWVKDPEGNTYMDMLSAYSAVNQGHRHPRIIQALKDQADKVTLVSRAFHSDNLGQWYEKICKLAGKDKALPMNTGAEAVETALKAARRWAYDVKGIEPNKAEIIAFNGNFHGRTMAPVSLSSEAEYQRGYGPLLDGFRKVEFGDVNQLKAAINKNTAAILVEPIQGEAGINVPPEGYLKTIRELCDEHQILFIADEIQAGLGRSGKLFATDWDHVKPDVYILGKALGGGVFPISVVLADNEVLDVFTPGSHGSTFGGNPLASAVSIAAIDVIIDEDLPGRSLELGEYFKSELKKIEHPSIKEVRGRGLFIGIELHESARPYCEALKEQGLLCKETHDTVIRFAPPLVITKEELDMALEKIKSVFA

SEQ ID NO: 3108 - protein, 103 aa, Staphylococcus epidermidis
KGRREIMPFKIFIITALIIVVLSMLAMLIRVILGPSLADRVVALDAIGLQLMAVIALFSILLNIKYMLVVILMVGILAFLGTAVFSKFMDEGKVIKHDSNDRH

SEQ ID NO: 3109 - protein, 163 aa, Staphylococcus epidermidis
EVNSLAIQFVINLLVSVIWLLVTNSYTLNNFVLGFILGLFLVYLLHRVLPGQFYLVRIYRIIMLIITFLTELIKANFGVLKIILKPRIENKPGFFVYETELERDWQLVLLSNLITLTPGTVVLGISDDRKKIYIHSIDFSTKEEEIQNIKSSLEKVVRKVGEK

SEQ ID NO: 3110 - protein, 110 aa, Staphylococcus epidermidis
SLLSGILTSISVYLVSSKSLIRIIMGTTLLTHAANLFLITMGGLKHGTVPIFEKGTSRYVDPIPQALILTAIVIAFATTAFFLVLAFRTYKELGTDNVELMKGAPEDDRE

SEQ ID NO: 3111 - protein, 203 aa, Staphylococcus epidermidis
HEWRIEMTNYPQLNKEIQDNEIKVVMHTNKGDMTFKLFPDIAPKTVENFVTHSKNGYYDGVTFHRVINDFMVQGGDPTATGMGGESIYGSAFEDEFSLEAFNLYGALSMANAGPNTNGSQFFIVQMKEVPENMLSQLADGGWPQPIVEAYGEKGGTPWLDQKHTVFGQLIEGESTLEDIANTKVGAQDKPVYDVVIESIDVEE

SEQ ID NO: 3112 - protein, 390 aa, Staphylococcus epidermidis
KQRGDSMHWTIIGGGLQGTTIALKLKNEGLKNEALTIIDPYSSLCERFNIYTQRISMPYLRSPFVHHIHPKPFHLKQYARYHQYTSAYYGPYKRPQRDMFMHHVHDLIHQFKLNDCHIQGKVEAINKSRGKWCIKLSTGDKMITDCVVIANGYTQTPFIPEIFRNKANVKHIFADNYHASLDKDTQHVVGSGISAAHLTLKLLNEHNHQLVHLWMNKDIEIHNFDADPGWLGPKKLNYLASISSSDARMKLIEDERHSGSMPMELFLRLKKYVQSGRLVIHTSQIDDVTESYIISAGKYFEYKHILLATGFYNQLLTQPLIKNLIQNEQAPLNQSGYPSLSNELEWLNQLFVAGGLADLELGPFARNIMGGKESAERISKAYKRLNKKIS

SEQ ID NO: 3113 - protein, 61 aa, Staphylococcus epidermidis
GNSISEIVPSSFDEVCVRGAKTKRFLTSTPLGSVKDLNKGSYLLFIFLILSLFNDVMTIAC

SEQ ID NO: 3114 - protein, 404 aa, Staphylococcus epidermidis
GVNMKDKIVLAYSGGLDTSVAVQWLIDKGYDVVACCLDVGEGKDLDVVYQKALDMGAVECHIIDATKEFSDDYVSYAIKGNLMYENAYPLVSALSRPLIAKKLVEIAEKTNSIGIAHGCTGKGNDQVRFEVAIKALNPKLKAFAPVREWAWSREEEIDYAIKHNIPVSINYDSPYSIDQNLWGRANECGILEDPYAAPPEDAFDLTTPLEETPDNADEIILTFKQGIPVQVDGKDYQLDDLILYLNQLAGKHGIGRIDHVENRMVGIKSREIYETPGAEVILKAHKALETITLTKDVAHFKPVIEKQFSEQIYNGLWFSPLTDSLKLFIDSTQQYVEGDVRIKLFKGNAIVNGRQSPYTLYDEKLATYTKEDAFNQESAVGFIDIYGLPTQVNALLHGGYSNEQ

SEQ ID NO: 3115 - protein, 353 aa, Staphylococcus epidermidis
KDVFMFKSKKIIISTLSTVTLGLASLSSPSIAETSNHSPAPNQSEKSIQQQTNIPSNMNQSSAKTFKRQAESDSVSGKTNDTHNHWTKNLTGEKFTTIAHRGASGYAPEHTFEAYDKSHNELGASYIEIDLQRTKDGHLVAMHDEKVNRTTNGHGRVDQLTLKELKQLDAGSWFNRKHPEYAKNKYKNAKVPTLDEILNRYGKNANYYIETKSPDVYPGMEKQLLDTLDKHDLLTQKSLKHGHVMIQSFSGSSLEKVHHMNANIPLIRLMNKFELKKATNQDLKNIKSYAIGVGPEYTDLNIKNTRHLKNLGFLVHPYTVDDENQMRNLNQYGVDGVFTNFADRYKKVSETQQ

SEQ ID NO: 3116 - protein, 484 aa, Staphylococcus epidermidis
VSLIFMVYLHKLMHYFTGGIVMSNKAWGGRFETQPEEWVDDFNASIDFDKNLIKQDVQGSIAHATMLAKQHIITDDEAQSIINELKNIQSDFEEGKLKFKASLEDIHLNIEHELIQRIGEAGGKLHTGRTRNDQVATDMHLYTKEQVQYIIELIASFQETIVQLADQHVDTIMPGYTHLQRAQPISFAHHIMTYFWMLERDKGRFMDSLKRIDISPLGAAALSGTTHPIDRHLTQELLGFANLYENSLDAVSDRDYIVETLHHISLTMVHLSRFAEEIIFWSTDEAKFITLSDAFSTGSSIMPQKKNPDMAELIRGKVGRTTGHLMSMLVTLKGLPLAYNKDMQEDKEGLFDAVHTLKGSLRIFEGMVASMKVNSNRLSQTVKNDFSNATELADYLVSKSVPFRTAHEIVGKIVLNCIHKGIYLLDVPLSEYQEHHENIEEDIYDYLTPENCLKRRQSYGSTGQESVKHQLKVAKALLKDNESK

SEQ ID NO: 3117 - protein, 120 aa, Staphylococcus epidermidis
SSMIATIVTSVSIIFVVLGALISAFAATGLIRLRDVYSRAHAAGKAATLGAMFLLFGAFLYFIGTEGYVNMQLIIGIIFVFITGPLSSHLIMKAAYNIKTPYTKDTKIDEIKEDMKHTKL

SEQ ID NO: 3118 - protein, 390 aa, Staphylococcus epidermidis
  UNSURE (207): Identity of amino acid at the above locations are unknown.
HAIVITSLNKESIKNMNNKYEPLFKSLTLPNGVEVRNRFVLAPLTHTSSNDDGTISDIELPYIEKRSKDVGIAINAASNVNDVGKAFPGQPSVAHDSDIEGLKELAQVMKKNGAKAIVQIHHGGAQALPELTPDGDVVAPSAISLKSFGQQKEHDTREMTAEEIEQTIRDFGEATRRAIEAGFDGVDIHGANQCLIPQFVSPYYNIXNDVWADNYKFPVAVIDEVVKAKKAHANDDFIIGYRLSPEEAESPGISMEITEELIHQIANKPLDYIHVSLMDVNSVTREGKYKGENRLELIHQWINGRMPLIGIGSVFTAEDALNAVENIGVEFVALGREILLDYDFVAKIKEGREDEIINAFDPNREDQHYLTPNLWEQFNQGFYPLPRKDK

SEQ ID NO: 3119 - protein, 60 aa, Staphylococcus epidermidis
FCLLVFIKLYERPYFFKYFIVKLHINTKYFGETLEGAGQVEDYRLKLSLRKRANNTRYCK

SEQ ID NO: 3120 - protein, 329 aa, Staphylococcus epidermidis
KVSSMLKLNPYKIGFRTVKTAVGMTLGVIICKLLGLDNYASSAILVVLCIKHTKMHSVQAILSRLVSCLLILFLGSAIFSLLGQHAFVLGLIVLLFIPLTVVLNVQEGVITSCVILLHVFNAKAINGHLILNEIMLLIVGLGIAFLMNLMMPSLDKKLNHFKQDIENQITEIFNIFSQACSMHNDHLNIKFDSLLLNIKKAKSLAFRDVKNHFVRNENSFYHYFDMREEQVELLKRMTSLLERINTDDPILEKISQLMYEIGSNVNSNDYTALRLHSLYEIRLSLDDLPLPTTHKTLNSRAHIIQILNELEEYLNIKSQFGSLKLHSEI

SEQ ID NO: 3121 - protein, 411 aa, Staphylococcus epidermidis
QFYSFIRCYNYVVYKEAYKMTEEFNESMINDIKEGDKVTGEVQQVEDKQVVVHINGGKFNGIIPISQLSTHHIENPSEVVKVGDEVEAYVTKIEFDEENDTGAYILSKRQLETEKSYEYLQEKLDNDEVIEAEVTEVVKGGLVVDVGQRGFVPASLISTDFIEDFSVFDGQTIRIKVEELDPENNRVILSRKAVEQLENDAKKASILDSLNEGDVIDGKVARLTNFGAFIDIGGVDGLVHVSELSHEHVQTPEEVVSVGEAVKVKVKSVEKDSERISLSIKDTLPTPFENIKGKFHEDDVIEGTVVRLANFGAFVEIAPSVQGLVHISEIDHKHIGSPNEVLEPGQQVNVKILGIDEDNERISLSIKATLPKENVIESDASTTQSYLEDDNDEDKPTLGDVFGDKFKDLKF

SEQ ID NO: 3122 - protein, 63 aa, Staphylococcus epidermidis
IVHSVYQLDILDKLPFINQMISVNISIPFSNCFLVMVNGGNNLITFLPAVKMINPIRLASRTT

SEQ ID NO: 3123 - protein, 61 aa, Staphylococcus epidermidis
SNPSTSIIINKDSSHYSKMLTRIAISCHTNERTSSSQRFSYYRIDELNLIDGDSNYTGARL

SEQ ID NO: 3124 - protein, 297 aa, Staphylococcus epidermidis
KEGLKMPQRVLLVDGMALLFRHFYATSLHNQFMYNSKGIPTNGIQGFVRHIFSAIKEIEPTHVAVCWDMGQETFRNEMYDGYKQNRPAPPDELIPQFDYVKEISHQFGFVNVGKRNYEADDIIGSLAETYSQEHEVYIITGDRDLLQCINHNVEVWLIKKGFTIYQRYTLDRFIDEYGLNPQQLIDVKAFMGDTADGYSGVKGIGEKTAIKLIQNHGTVENVVNNLSSLTPAQQKKITNNLNHLHLSKSLAEIYTKVPIETDKLFKEMTYAHTLNEILSICNEHELYVSSKYIATHL

SEQ ID NO: 3125 - protein, 155 aa, Staphylococcus epidermidis
FEVLIVPKKSVRHIKIREIISNEQIETQDELVKRLNEYDLNVTQATVSRDIKELQLIKVPAPTGQYVYSLPNDRRYHPLEKLGRYLMDSFVNIEGTGNLLVLKTLPGNAQSIGAILDQIDWDEVLGTICGDDTCLLICRDEEASEEIKTRIFNLL

SEQ ID NO: 3126 - protein, 314 aa, Staphylococcus epidermidis
IRQLKCIERRLDMQKNILKSGIEISELGLGCMSLGTDYKKAQPIIESAIDNGITYFDTADIYDQGVNEEIVGKALKKYQNRDDIVIGTKVGNRLTDDGHMTWDPSKKHIKESVKGSLKRLGLNHLDLYQLHGGTIDDPLDETISAFDELKQEGYIRAYGISSIRPNVIDYYLKNSQIETLMSQFNLIDNRPESLINDVHDKQVKILARGPVFKGLLTSKSVDVIDEKFKNGVLDYTQDELGSTIASIKELESNLTALSFKYLTSHDAMGSIIVGASSVEQLEENVRNYYKEISLDQIKSARNRVKDIEYTQHLK

SEQ ID NO: 3127 - protein, 81 aa, Staphylococcus epidermidis
FVHTCSYVGFSTCPPLYPETTDFIPGYEVKGLTMHQKQPPASVAYAMLYSLLKLSVCLNLRYIVGNLKYLTQNHSCDFVTT

SEQ ID NO: 3128 - protein, 495 aa, Staphylococcus epidermidis
GCDTMNDHQKNHATSQDDNTKSTPSKNSKHIKIKLWHFILVILGIILLTSIITVVSTILISHQKSGLNKEQRANLKKIEYVYQTLNKDYYKKQSSDKLTQSAIDGMVKELKDPYSEYMTAEETKQFNEGVSGDFVGIGAEMQKKNEQISVTSPMKDSPAEKAGIQPKDIVTQVNHHSVVGKPLDQVVKMVRGKKGTYVTLTIKRGSQEKDIKIKRDTIHVKSVEYEKKGNVGVLTINKFQSNTSGELKSAIIKAHKQGIRHIILDLRNNPGGLLDEAVKMANIFIDKGNTVVQLEKGKDKEELKTSNQALKQAKDMKVSILVNEGSASASEVFTGAMKDYHKAKVYGSKTFGKGIVQTTREFSDGSLIKYTEMKWLTPDGHYIHGKGIRPDVSISTPKYQSLNVIPDNKTYHQGEKDKNVKTMKIGLKALGYPIDNETNIFDEQLESAIKTFQQDNNLKVNGNFDKKTNDKFTEKLVEKANKKDTVLNDLLNKLK

SEQ ID NO: 3129 - protein, 203 aa, Staphylococcus epidermidis
HLITNITTGLKDVVEVTFNQITVDGDTSTNDMVLVMSNGCTNNNEIKKDSEDYYKFKQMLLYIMTDLAKSIARDGEGASKLIEVTVKGAKESSAARMIAKSVVGSSLVKTAIFGEDPNWGRIIAAAGYAKTYFDINQVDIFIGRIPVLIRSSPVKYDKEEIQEIMSAEEISIQLDLHQGNCEGQAWGCDLSYDYVKINALYTT

SEQ ID NO: 3130 - protein, 130 aa, Staphylococcus epidermidis
ESEADSIVWMGENGGFLLFKFPPFLSKMNGRRKLYMQQNKRLITISMLSAVAFVLTFIKFPLPFIPPYLTLDFSDVPTLLATFLLSPIAGIIVALIKNILNFLFNIGDPVGPVANFLARRQLFAIIILCL

SEQ ID NO: 3131 - protein, 112 aa, Staphylococcus epidermidis
ANAAHYGASKAGFSAVLNALRLEQPELKVLNVQPGPIDTPFQKNADPTLKYFKNYRHMMIQPQQLAKQIVEGIILNKIEINQPSWMQIMLKFYQLCPRTLEKLCPNLFKNKV

SEQ ID NO: 3132 - protein, 154 aa, Staphylococcus epidermidis
RSEASVEERLNRVKQQLQQSSYKLTPQREATVRVLIENEKDHLSAEDVYLKVKDKAPEIGLATVYRTLELLAEIKVLDKINFGDGVARFDLRKEGAKHFHHHLVCMECGKVEEIEEDLLPEVENRVENEFNFKILDHRLTFHGVCFECQAKNKQ

SEQ ID NO: 3133 - protein, 323 aa, Staphylococcus epidermidis
GFNLYNILSYAMSHAFNYKTNKSIYNILTGKKSHQTFFDASSQQLLSLYHSLPNLKYSTFEQFILQKDDFKKSIQVKIHPQYTYDSLTQTFSCIQLLIQTLSHTRKESNTFIPIVQNTYIQQRVKQLYHQVIESNQVSNTIDEIYLLFENLNNKYNHTFLHYYLQGYEESMYTRQQISLIEGIPQSELFEREMNELIDILNQLKDSTKYPILSQAIILSPLLTNTYLSYQKLKSGLNLKEIAQLQNVKLNTIEDHILEMYIKGYLIDYTLFINKKDILEFINYYQKHRGERLKFYKEHFTDWTYFQIKLVIVGIERGDLIAER

SEQ ID NO: 3134 - protein, 170 aa, Staphylococcus epidermidis
ECIYMFKKLFGKAKEVDKNIKIYAPLTGEYVKIEDIPDPVFAQKMMGEGFGINPTEGEVVSPIEGKVDNVFPTKHAVGLKAENGLELLVHIGLDTVQLDGKGFEVLVESGDDIKIGDPLIRFDLEYINNNAKSIISPIIITNSDQTESIHIEDVQAVVKGETQVIDVTVS

SEQ ID NO: 3135 - protein, 154 aa, Staphylococcus epidermidis
KSIYRITLGRLKMIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 3136 - protein, 238 aa, Staphylococcus epidermidis
EESYMYNEIFGIASFIVTFALMVLMYRCFGKQGLIAWVAIGTIIANIQVIKAVHIFGITATLGNVMFASIYLATDILNDIYGRKVAKRAVWLGFSSTLVMIIVMQMSLHFIPAPVDNAQNSLKMIFDLVPRIAIGSIIAYIIGQHIDVFIFSMIKKIFSSDKTFFIRAYGSTILSSIIDTGLFVSIAFIGTMPGTAVFEIFITTYLLKLVSTIFNVPFGYIAKSLYRKGKIEQLDNGY

SEQ ID NO: 3137 - protein, 352 aa, Staphylococcus epidermidis
RNTYSYYSKKKKLKTKGNSIMRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGYGDNAKAALMTRGLAEISRLGEKLGADPMTFLGLGGIGDLIVTCTSTHSRNYTLGFKLGQGKTAEEALKEMKMVVEGMYTTKSVYHLAQQEGVEMPITNALYEVLFEDVPVSKSVRTLMERDKKAE

SEQ ID NO: 3138 - protein, 190 aa, Staphylococcus epidermidis
KYQYDLNLLLPLVKILKKRCFSKMIRLATKNDLLSITQLVKDAKQIMEEFNNNQWDDEYPAKEHVEEDIEYKTLYVLDVDHTIYGLIVIDQNQSEWYDDIDWPVNPNGAYVIHRLPGSKQYKGAATELFQFAIDLANEHDIHVILTDTFALNKPAQGLFEKFGFTKVDEIEIDYHPFDRGAPFYAYYKNI

SEQ ID NO: 3139 - protein, 438 aa, Staphylococcus epidermidis
KEKYRSLVMKTTIKQAKKHLNQEVTIGAWLTNKRSSGKIAFLQLRDGTGFMQGVVVKSEVDEETFQLAKDITQESSLYITGTITEDNRSDLGYEMQVKSIEIVHEAHDYPITPKNHGTEFLMDHRHLWLRSKKQHAVMKIRNEIIRATYEFFNENGFTKIDPPILTASAPEGTSELFHTKYFDEDAFLSQSGQLYMEAAAMAHGRVFSFGPTFRAEKSKTRRHLIEFWMIEPEMAFTNHAESLEIQEQYVSHIVQSVLNHCQLELKALDRDTTKLEKVATPFPRISYDDAIEFLKKEGFDDIEWGEDFGAPHETAIANHYDLPVFITNYPTKIKPFYMQPNPDNEDTVLCADLIAPEGYGEIIGGSERINDLELLEQRINEHELDEESYSYYLDLRRYGSVPHSGFGLGLERTVAWISGVEHVRETSPFPRLLNRLYP

SEQ ID NO: 3140 - protein, 104 aa, Staphylococcus epidermidis
YNEYHYKTSGGEFIMNKTDLINAVAEQADLTKKEAGSAVDAVFESIQNSLAKGEKVQLIGFGNFEVRERAARKGRNPQTGKEIDIPASKVPAFKAGKALKDAVK

SEQ ID NO: 3141 - protein, 574 aa, Staphylococcus epidermidis
ETGYITILRRMYMFRKSMLILMIAVILFVTACSKDKTQDEAKRKADAKGKPDTWIADRKLKGLVFQSDNDASPKMNKEVAQELKKKTGITLELQTVSNEDSTEALTSGLASGDLPDFIVYYLDDSGRPEMKVLNKAAKQGRLTDLTKMLKNTKIYSKYFKKGYLPKDTKDNIMFNKEQDGTYLVHMGINRHPGQEERRTVGGPYVRKDIMDKLHIDPTSIKTSKDVEKLAEKMKEHHFKDDNGKEITPIGPTAWGGDDRTKFYNDLVWTGQSDEKFLNKGKKIIHESQTEYPLKRVHYVKDLMKKGLMTKEFYTMEENKAKEGLVNGSWGIVSDLHNYVTENQSMKYVPLGPLNTVKGKFRVEKPYKSGANGWAVPSTTEHPEDVVKLADFLASRRGKLLGQYGIKGRDYTLDKKGNPHVKPEVLKEVENNPDEAKKRGFRGAGSYWADHLGYTDIDNKADFGETEYGDNTKTKKTTPEKIADMWHYDQRQKHAKIVNGLTVKSFLSKYEYGEDLEVALDDYSDAIKRAYYSQSDKETKQIIDSAKQRLEEAGLNQFERYVENQRDKKGTQIIY

SEQ ID NO: 3142 - protein, 257 aa, Staphylococcus epidermidis
IIMYKRNERLNLIRKRVDQYGQVAVKDLAIFLQVTPETVRKDLETLENDKLITRTHGGAIQYNHINKEKSYANKWQKQSQVKERIAKKAALQIKSGEIIVIDGGTTTGRIPQYLNDITQTTIVTNSLKIADELNRAIEEQRIQAEVIMLAGKTNTEQDVVRGHMTNELLQRFKFDKAFISCGSFDTSDCYEFDLEEAHASHIMIQKSQLSYLLADSSKRDAHASYRIDGFSEIDYMISDYAKPQNIEYFNQKHWLQI

SEQ ID NO: 3143 - protein, 425 aa, Staphylococcus epidermidis
NKNLLVCLTDLCCVIEYDNILNILQFNVLKNRKGRAIMRYLTSGESHGPQLTVIIEGVPANLEIKAEDINKEMFKRQGGYGRGRRMKIEKDTIEIVSGVRNGFTLGSPITLVVTNDDFTHWRKIMGVAPISDEERENMKRTITKPRPGHADLIGGMKYNHRDLRNVLERSSARETAARVAVGAVSKILLEQLDIHLYSRVVEIGGIKDKGLYDVDMFKNNVDKNDVRVIDENIAQQMRDKIDEAKKDGDSIGGVVQVMAENMPIGVGSYVHYDRKLDGRIAQGVVSINAFKGVSFGEGFKAAEKPGSEIQDEIHYNQDSGYFRATNHLGGFEGGMSNGMPIIVNGVMKPIPTLYKPLNSVDINTKEDFKATIERSDSCAVPAASVVCEHVVAFELAKAVLEEFQSNHMDQLVAQIKERRQLNIEF

SEQ ID NO: 3144 - protein, 371 aa, Staphylococcus epidermidis
LNLQRSKDMIQIKDLNKVYDNGSYAVKDFNLDIEDNEFVVFVGPSGCGKSTTLRMIAGLEDVSKGTISINDKVINDLQPKDRKIAMVFQNYALYPHMTVYKNLAFGLKMRGIKKKIYDEKIQHAAQILEIENLLDRKPKALSGGQRQRVALGRAIVREAQIFLMDEPLSNLDAKLRSNMRSEIIKIHKQMKATTIYVTHDQTEAMTMASRIVILKQGEIQQIGTPEEIYRHPVNEFVATFIGSPSMNMVPMTYNMDAWYFDGQKVADATLLQLASHAQYRLGIRPEDLHLVNDNEISNYPIQLSQFTVDLVELTGSYKLLHCHHNEHKIIAAVDSNLDFELGQTVSFGIKTEDAHFFDSDSGERVQEEVLS

SEQ ID NO: 3145 - protein, 203 aa, Staphylococcus epidermidis
KVVHTKMYQWLWETSLYQKWLISFILICNIFGTIYGYHWYSSQLANTPNYFKLFVPDSPTATLFLCLSLLFILFNKRYALIDALAFITLFKYGSWAVIMNILMFIKMNDIAINGLMLLISHAIMILEAIYFYPRFKISKLAGLMSFIWVTINDVIDYIYGQYPYYDFIAKHLIEVGVLAYSLTIISYILFLKLQKWLKVKTFD

SEQ ID NO: 3146 - protein, 65 aa, Staphylococcus epidermidis
RSNQGGMSMSNLWIIFAVTVLIAVYSAIEVFTNLNHKQQPRFKYFTIAFVVFIILAIIEVIFLAQ

SEQ ID NO: 3147 - protein, 79 aa, Staphylococcus epidermidis
KLNQKQTEPKITYILQVLLTNRALMSKFSPFIKIYLTLVVGPIIENFARKFYGQTKLNFEASSAHGTLIRFCITIFLIQ

SEQ ID NO: 3148 - protein, 443 aa, Staphylococcus epidermidis
GGCQLDIKMPKLGESVHEGTIEQWLVSVGDHVDEYEPLCEVITDKVTAEVPSTISGTITELVVEEGQTVNINTVICKIDSENGQNQTESANEFKEEQNQHSQSNINVSQFENNPKTHESEVHTASSRANNNGRFSPVVFKLASEHDIDLTQVKGTGFEGRVTKKDIQNIINNPNDQEKEKEFKQTDKKDHSTNHGDFLHQSSTKNEHSPSSNERVVPVKGIRKAIAQNMVTSVSEIPHGWMMVEADATNLVQTRNYHKAQFKQNEGYNLTFFAFFVKAVAEALKVNPLLNSTWQGDEIVIHKDINISIAVADDDKLYVPVIKNADEKSIKGIAREINDLATKARLGKLAQSDMQNGTFTVNNTGSFGSVSSMGIINHPQAAILQVESVVKKPVVIDDMIAIRNMVNLCISIDHRILDGVQTGKFMNLVKKKIEQYSIENTSIY

SEQ ID NO: 3149 - protein, 231 aa, Staphylococcus epidermidis
KISHILKMYHILIRKGLLNMKTVLIVGANGRVSIEATKIFLENSRFNVDLFLRNAHRIPDYASNRIKVYEGDAKNIEDLESALNNVDVVFASLSGSLDKQAETIVKAMDNKNVKRLIFVAAPGIYDELPEPFNQWNKEQFGEKLNRYRKASDIIENSDLDYTIIRPGWLTDKNENVYEITAKNETFKGTEVSRKSVASLAVQIAKNPELHSKENIGVNKPNTEGNKPAWFN

SEQ ID NO: 3150 - protein, 471 aa, Staphylococcus epidermidis
RKIHRNSTWRRVCDSMIKRQKLKYKWMLITTLITFTTILLFCLIIIFFLKDTLRSSEIDEAERSSNDIANLFHSKSLSDISALDLNASLENFQEILIYDDKGRKLIQTSNDNTLAYDNKIDFKHPERIHIQRSHGINYLVITEPIRSKDFSGYSVLVHSLQNYDNLVKSLYIVALAFGLIATIITAGVSYIFSSQITKPIVTMSNKMNQIRRDGFQNKLELTTNYEETDNLIDTFNEMMYQIEESFNQQRQFVEDASHELRTPLQIIQGHLNLIQRWGKKDPAVLEESLNISIEEVNRITKLVEELLLLTKDRVNHNVLECENVDVNSEIQSRVKSLQHLHPDYTFETHLATKPIQLKINRHQFEQLLLIFIDNAMKYDTEHKHIKIVTQLKNKMIMIDITDHGMGIPKADLEFIFDRFYRVDKSRARSQGGNGLGLSIAEKIVQLNGGMIQVESELQKYTTFKISFPVLN

SEQ ID NO: 3151 - protein, 243 aa, Staphylococcus epidermidis
NMSQMMFDNFLSSSRAKWGERSGLTLFLPHVFEGQGPEHSSARLERFLQLAAENNSTVVNLSSASNYFHLLRAQAASLDTLEMRPLIVMSPKSLLRNKTVAKPIDEFTSGGFKPIITEDIDEQKVKKVILASGKMYIDLKEYLAKNPNDSILLIAVERLYPFPEEEIKEVLKSLPHLENVSWVQEEPKNQGAWLFVYPYLKALVANKYDLTYHGRIQRAAPAEGDGEIHKLVQTKIIESSINN

SEQ ID NO: 3152 - protein, 188 aa, Staphylococcus epidermidis
RKFKQTDNLRREYNMAYATLAGGCFWCMVKPFTSYPGIKSVVSGYSGGHVENPTYEQVCTNQTGHVEAVQIEYDPNITTFENILDVYFKTFDPTDDGGQFFDRGESYQPVIFYHDENQLKAAELKKQQIDEEGIFKKPVITPIKPYKNFYPAEEYHQDYYKKNPTHYEQYQRGSGRKAFIESHWGGSK

SEQ ID NO: 3153 - protein, 560 aa, Staphylococcus epidermidis
FFNNIGGDIMKRNWWKEAVAYQVYPRSFNDSNGDGIGDLPGLIEKLDYLENLGIDVIWLSPMYPSPNDDNGYDISDYKGIMSEFGTMNDFDQLLSSIHQRGMKLILDLVVNHTSDEHPWFIESKSSKTNAKRDWYIWADPKPDGSEPNNWESIFNGSTWEFDESTKQYYFHLFSKKQPDLNWENPDVRQAVFEMMNWWFEKGIDGFRVDAITHIKKNFEAGDLPVPDGKKFAPAFDVDMNQPGIQEWLQEMKDKSLSRYDIMTVGEANGVTPNDAEEWVGEENGKFNMIFQFEHLGLWSTGDTKFDVKSYKQVLNRWQKQLENVGWNALFIENHDQPRRVSTWGDDKNYWYESATSHATAYFLQQGTPFIYQGQEIGMTNYPFESIESFNDVAVKTEYQIVKKEGGDVNQLLDKYKMENRDNARTPMQWNNSINAGFTTGKPWFHVNPNYTEINVKQQLNDKFSILSYYKALIQLKKSDLIYTYGKFNMVDAENKQVFAYTRTFKNNTVLIVANLTNEVSELNLPFELDISSVDIKLHNYHLNDINLDHIKPYESFVVEI

SEQ ID NO: 3154 - protein, 79 aa, Staphylococcus epidermidis
CDSKLMVKNYSFYQFIMTVRGRKDDKGVFAEQIFEDLAFPKHEDDFNTLSEYIETHSEFTLPMSVFDDLYDDYTEWLKF

SEQ ID NO: 3155 - protein, 282 aa, Staphylococcus epidermidis
IEFKIEGVELNMKLVFYGAGNMAQAIFTGIINSNNLNANDIYLTNKSNEQALKSFAEKLGVNYSYDDEALLKDADYVFLGTKPHDFENLANRIREHITNDNRFISIMAGLSIDYIRQQLNTNNPLARIMPNTNAQVGHSVTGISFSNNFDPKSKNEVDELINAFGSVIEVSEEHLHQVTAITGSGSAFLYHVFEQYVKAGTELGLERNQVEESIRNLIIGTSKMIERSDLSMSQLRKNITSKGGTTQAGLDALSQYDIVSMFEDCLGAAVNRSMELSHKEDE

SEQ ID NO: 3156 - protein, 121 aa, Staphylococcus epidermidis
RMVNVADYSQSNLGKIEIAPEVLSVIASIATSEVEGITGHFAELKKTNLEKISRKNLNRDLKIEAKEDGIYIDVFCSLKHGVNISKTANQIQSAIFNSITTMTAIEPQQINIHIRSIVAEK

SEQ ID NO: 3157 - protein, 64 aa, Staphylococcus epidermidis
HKAKICAEVYRSLCKFFLVLSHLTPSTKMMKRLHGYHSIISYIVKVHLPIIIQNRSKTEFTPNS

SEQ ID NO: 3158 - protein, 344 aa, Staphylococcus epidermidis
WSSNSCIVGGKKMIDYKSAGLTEEDLKKIYKWMDLGRKTDERLWLLNRAGKIPFVVSGQGQEATQIGMAYAMQKGDISSPYYRDLAFVTYMGISPLDTMLSAFGKRDDINSGGKQMPSHFSHKEKGILSQSSPVATQIPHSVGAALALKMDNKPNIATATVGEGSSNQGDFHEGMNFAAVHKLPFVCVIINNKYAISVPDSLQYAAEKLSDRALGYGMHGIQVDGNDPIAVYKAMKEARERALAGEGPTLIEAVTSRMTPHSSDDDDTYRTKEERDLLKQEDCNIKFKTALLDQGIINENWLSQLEKEHKELINEATKSAEAAPYPSEEEALTYVYEEGGQRND

SEQ ID NO: 3159 - protein, 10182 aa, Staphylococcus epidermidis
MKSKPKLNGRNICSFLLSKCMSYSLSKLSTLKTYNFQITSNNKEKTSRIGVAIALNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFSQENLQNAARSGRPIQFLVGFDVEDSHHNPETLLPVNLYVKPELKHTIELYHDNEKQDRKEFSVSKRAGHGVFQVMSGTLHNTVGSGILPYQQEIRIKLTSNEPIKDSEWSITGYPNTLTLQNAVGRTNNATEKNLALVGHIDPGNYFITVKFGDKVEQFEIRSKPTPPRIITTANELRGNPNHKPEIRVTDIPNDTTAKIKLVMGGTDGDHDPEINPYTVPENYTVVAEAYHDNDPSKNGVLTFRSSDYLKDLPLSGELKAIVYYNQYVQSNFSNSVPFSSDTTPPTINEPAGLVHKYYRGDHVEITLPVTDNTGGSGLRDVNVNLPQGWTKTFTINPNNNTEGTLKLIGNIPSNEAYNTTYHFNITATDNSGNTTNPAKTFILNVGKLADDLNPVGLSRDQLQLVTDPSSLSNSEREEVKRKISEANANIRSYLLQNNPILAGVNGDVTFYYRDGSVDVIDAENVITYEPERKSIFSENGNTNKKEAVITIARGQNYTIGPNLRKYFSLSNGSDLPNRDFTSISAIGSLPSSSEISRLNVGNYNYRVNAKNAYHKTQQELNLKLKIVEVNAPTGNNRVYRVSTYNLTNDEINKIKQAFKAANSGLNLNDNDITVSNNFDHRNVSSVTVTIRKGDLIKEFSSNLNNMNFLRWVNIRDDYTISWTSSKIQGRNTDGGLEWSPDHKSLIYKYDATLGRQINTNDVLTLLQATAKNSNLRSNINSNEKQLAERGSNGYSKSIIRDDGEKSYLLNSNPIQVLDLVEPDNGYGGRQVSHSNVIYNEKNSSIVNGQVPEANGASAFNIDKVVKANAANNGIMGVIYKAQLYLAPYSPKGYIEKLGQNLSNTNNVINVYFVPSDKVNPSITVGNYDHHTVYSGETFKNTINVNDNYGLNTVASTSDSAITMTRNNNELVGQAPNVTNSINKIVKVKATDKSGNESIVSFTVNIKPLNEKYRITTSSSNQTPVRISNIQNNANLSIEDQNRVKSSLSMTKILGTRNYVNESNNDVRSQVVSKVNRSGNNATVNVTTTFSDGTTNTITVPVKHVLLEVVPTTRTTVRGQQFPTGKGTSPNDFFSLRTGGPVDARIVWVNNQGPDINSNQIGRDLTLHAEIFFDGETTPIRKDTTYKLSQSIPKQIYETTINGRFNSSGDAYPGNFVQAVNQYWPEHMDFRWAQGSGTPSSRNAGSFTKTVTVVYQNGQTENVNVLFKVKPNKPVIDSNSVISKGQLNGQQILVRNVPQNAQVTLYQSNGTVIPNTNTTIDSNGIATVTIQGTLPTGNITAKTSMTNNVTYTKQNSSGIASNTTEDISVFSENSDQVNVTAGMQAKNDGIKIIKGTNYNFNDFNSFISNIPAHSTLTWNEEPNSWKNNIGTTTKTVTVTLPNHQGTRTVDIPITIYPTVTAKNPVRDQKGRNLTNGTDVYNYIIFENNNRLGGTASWKDNRQPDKNIAGVQNLIALVNYPGISTPLEVPVKVWVYNFDFTQPIYKIQVGDTFPKGTWAGYYKHLENGEGLPIDGWKFYWNQQSTGTTSDQWQSLAYTRTPFVKTGTYDVVNPSNWGVWQTSQSAKFIVTNAKPNQPTITQSKTGDVTVTPGAVRNILISGTNDYIQASADKIVINKNGNKLTTFVKNNDGRWTVETGSPDINGIGPTNNGTAISLSRLAVRPGDSIEAIATEGSGETISTSATSEIYIVKAPQPEQVATHTYDNGTFDILPDNSRNSLNPTERVEINYTEKLNGNETQKSFTITKNNNGKWTINNKPNYVEFNQDNGKVVFSANTIKPNSQITITPKAGQGNTENTNPTVIQAPAQHTLTINEIVKEQGQNVTNDDINNAVQVPNKNRVAIKQGNALPTNLAGGSTSHIPVVIYYSDGSSEEATETVRTKVNKTELINARRRLDEEISKENKTPSSIRNFDQAMNRAQSQINTAKSDADQVIGTEFATPQQVNSALSKVQAAQNKINEAKALLQNKADNSQLVRAKEQLQQSIQPAASTDGMTQDSTRNYKNKRQAAEQAIQHANSVINNGDATSQQINDAKNTVEQAQRDYVEAKSNLRADKSQLQSAYDTLNRDVLTNDKKPASVRRYNEAISNIRKELDTAKADASSTLRNTNPSVEQVRDALNKINTVQPKVNQAIALLQPKENNSELVQAKKRLQDAVNDIPQTQGMTQQTINNYNDKQREAERALTSAQRVIDNGDATTQEITSEKSKVEQAMQALTNAKSNLRADKNELQTAYNKLIENVSTNGKKPASIRQYETAKARIQNQINDAKNEAERILGNDNPQVSQVTQALNKIKAIQPKLTEAINMLQNKENNTELVNAKNRLENAVNDTDPTHGMTQETINNYNAKKREAQNEIQKANMIINNGDATAQDISSEKSKVEQVLQALQNAKNDLRADKRELQTAYNKLIQNVNTNGKKPSSIQNYKSARRNIENQYNTAKNEAHNVLENTNPTVNAVEDALRKINAIQPEVTKAINILQDKEDNSELVRAKEKLDQAINSQPSLNGMTQESINNYTTKRREAQNIASSADTIINNGDASIEQITENKIRVEEATNALNEAKQHLTADTTSLKTEVRKLSRRGDTNNKKPSSVSAYNNTIHSLQSEITQTENRANTIINKPIRSVEEVNNALHEVNQLNQRLTDTINLLQPLANKESLKEARNRLESKINETVQTDGMTQQSVENYKQAKIKAQNESSIAQTLINNGDASDQEVSTEIEKLNQKLSELTNSINHLTVNKEPLETAKNQLQANIDQKPSTDGMTQQSVQSYERKLQEAKDKINSINNVLANNPDVNAIRTNKVETEQINNELTQAKQGLTVDKQPLINAKTALQQSLDNQPSTTGMTEATIQNYNAKRQKAEQVIQNANKIIENAQPSVQQVSDEKSKVEQALSELNNAKSALRADKQELQQAYNQLIQPTDLNNKKPASITAYNQRYQQFSNELNSTKTNTDRILKEQNPSVADVNNALNKVREVQQKLNEARALLQNKEDNSALVRAKEQLQQAVDQVPSTEGMTQQTKDDYNSKQQAAQQEISKAQQVIDNGDATTQQISNAKTNVERALEALNNAKTGLRADKEELQNAYNQLTQNIDTSGKTPASIRKYNEAKSRIQTQIDSAKNEANSILTNDNPQVSQVTAALNKIKAVQPELDKAIAMLKNKENNNALVQAKQQLQQIVNEVDPTQGMTTDTANNYKSKKREAEDEIQKAQQIINNGDATEQQITNETNRVNQAINAINKAKNDLRADKSQLENAYNQLIQNVDTNGKKPASIQQYQAARQAIETQYNNAKSEAHQILENSNPSVNEVAQALQKVEAVQLKVNDAIHILQNKENNSALVTAKNQLQQSVNDQPLTTGMTQDSINNYEAKRNEAQSAIRNAEAVINNGDATAKQISDEKSKVEQALAHLNDAKQQLTADTTELQTAVQQLNRRGDTNNKKPRSINAYNKAIQSLETQITSAKDNANAVIQKPIRTVQEVNNALQQVNQLNQQLTEAINQLQPLSNNDALKAARLNLENKINQTVQTDGMTQQSIEAYQNAKRVAQNESNTALALINNGDADEQQITTETDRVNQQTTNLTQAINGLTVNKEPLETAKTALQNNIDQVPSTDGMTQQSVANYNQKLQIAKNEINTINNVLANNPDVNAIKTNKAEAERISNDLTQAKNNLQVDTQPLEKIKRQLQDEIDQGTNTDGMTQDSVDNYNDSLSAAIIEKGKVNKLLKRNPTVEQVKESVANAQQVIQDLQNARTSLVPDKTQLQEAKNRLENSINQQTDTDGMTQDSLNNYNDKLAKARQNLEKISKVLGGQPTVAEIRQNTDEANAHKQALDTARSQLTLNREPYINHINNESHLNNAQKDNFKAQVNSAPNHNTLETIKNKADTLNQSMTALSESIADYENQKQQENYLDASNNKRQDYDNAVNAAKGILNQTQSPTMSADVIDQKAEDVKRTKTALDGNQRLEVAKQQALNHLNTLNDLNDAQRQTLTDTINHSPNINSVNQAKEKANTVNTAMTQLKQTIANYDDELHDGNYINADKDKKDAYNNAVNNAKQLINQSDANQAQLDPAEINKVTQRVNTTKNDLNGNDKLAEAKRDANTTIDGLTYLNEAQRNKAKENVGKASTKTNITSQLQDYNQLNIAMQALRNSVNDVNNVKANSNYINEDNGPKEAYNQAVTHAQTLINAQSNPEMSRDVVNQKTQAVNTAHQNLHGQQKLEQAQSSANTEIGNLPNLTNTQKAKEKELVNSKQTRTEVQEQLNQAKSLDSSMGTLKSLVAKQPTVQKTSVYINEDQPEQSAYNDSITMGQTIINKTADPVLDKTLVDNAISNISTKENALHGEQKLTTAKTEAINALNTLADLNTPQKEAIKTAINTAHTRTDVTAEQSKANQINSAMHTLRQNISDNESVTNESNYINAEPEKQHAFTEALNNAKEIVNEQQATLDANSINQKAQAILTTKNALDGEEQLRRAKENADQEINTLNQLTDAQRNSEKGLINSSQTRTEVASQLAKAKELNKVMEQLNHLINGKNQMINSSKFINEDANQQQAYSNAIASAEALKNKSQNPELDKVTIEQAINNINSAINNLNGEAKLTKAKEDAVASINNLSGLTNEQKTKENQAVNGAQTRDQVANKLRDAEALDQSMQTLRDLVNNQNAIHSTSNYFNEDSTQKNTYDNAIDNGSTYITGQHNPELNKSTIDQTISRINTAKNDLHGVEKLQRDKGTANQEIGQLGYLNDPQKSGEESLVNGSNTRSEVEEHLNEAKSLNNAMKQLRDKVAEKTNVKQSSDYINDSTEHQRGYDQALQEAENIINEIGNPTLNKSEIEQKLQQLTDAQNALQGSHLLEEAKNNAITGINKLTALNDAQRQKAIENVQAQQTIPAVNQQLTLDREINTAMQALRDKVGQQNNVHQQSNYFNEDEQPKHNYDNSVQAGQTIIDKLQDPIMNKNEIEQAINQINTTQTALSGENKLHTDQESTNRQIEGLSSLNTAQINAEKDLVNQAKTRTDVAQKLAAAKEINSAMSNLRDGIQNKEDIKRSSAYINADPTKVTAYDQALQNAENIINATPNVELNKATIEQALSRVQQAQQDLDGVQQLANAKQQATQTVNGLNSLNDGQKRELNLLINSANTRTKVQEELNKATELNHAMEALRNSVQNVDQVKQSSNYVNEDQPEQHNYDNAVNEAQATINNNAQPVLDKLAIERLTQTVNTTKDALHGAQKLTQDQQAAETGIRGLTSLNEPQKNAEVAKVTAATTRDEVRNIRQEATTLDTAMLGLRKSIKDKNDTKNSSKYINEDHDQQQAYDNAVNNAQQVIDETQATLSSDTINQLANAVTQAKSNLHGDTKLQHDKDSAKQTIAQLQNLNSAQKHMEDSLIDNESTRTQVQHDLTEAQALDGLMGALKESIKDYTNIVSNGNYINAEPSKKQAYDAAVQNAQNIINGTNQPTINKGNVTTATQTVKNTKDALDGDHRLEEAKNNANQTIRNLSNLNNAQKDAEKNLVNSASTLEQVQQNLQTAQQLDNAMGELRQSIAKKDQVKADSKYLNEDPQIKQNYDDAVQRVETIINETQNPELLKANIDQATQSVQNAEQALHGAEKLNQDKQTSSTELDGLTDLTDAQREKLREQINTSNSRDDIKQKIEQAKALNDAMKKLKEQVAQKDGVHANSDYTNEDSAQKDAYNNALKQAEDIINNSSNPNLNAQDITNALNNIKQAQDNLHGAQKLQQDKNTTNQAIGNLNHLNQPQKDALIQAINGATSRDQVAEKLKEAEALDEAMKQLEDQVNQDDQISNSSPFINEDSDKQKTYNDKIQAAKEIINQTSNPTLDKQKIADTLQNIKDAVNNLHGDQKLAQSKQDANNQLNHLDDLTEEQKNHFKPLINNADTRDEVNKQLEIAKQLNGDMSTLHKVINDKDQIQHLSNYINADNDKKQNYDNAIKEAEDLIHNHPDTLDHKALQDLLNKIDQAHNELNGESRFKQALDNALNDIDSLNSLNVPQRQTVKDNINHVTTLESLAQELQKAKELNDAMKAMRDSIMNQEQIRKNSNYTNEDLAQQNAYNHAVDKINHIIGEDNATMDPQIIKQATQDINTAINGLNGDQKLQDAKTDAKQQITNFTGLTEPQKQALENIINQQTSRANVAKQLSHAKFLNGKMEELKVAVAKASLVRQNSNYINEDVSEKEAYEQAIAKGQEIINSENNPTISSTDINRTIQEINDAEQNLHGDNKLRQAQEIAKNEIQNLDGLNSAQITKLIQDIGRTTTKPAVTQKLEEAKAINQAMQQLKQSIADKDATLNSSNYLNEDSEKKLAYDNAVSQAEQLINQLNDPTMDISNIQAITQKVIQAKDSLHGANKLAQNQADSNLIINQSTNLNDKQKQALNDLINHAQTKQQVAEIIAQANKLNNEMGTLKTLVEEQSNVHQQSKYINEDPQVQNIYNDSIQKGREILNGTTDDVLNNNKIADAIQNIHLTKNDLHGDQKLQKAQQDATNELNYLTNLNNSQRQSEHDEINSAPSRTEVSNDLNHAKALNEAMRQLENEVALENSVKKLSDFINEDEAAQNEYSNALQKAKDIINGVPSSTLDKATIEDALLELQNARESLHGEQKLQEAKNQAVAEIDNLQALNPGQVLAEKTLVNQASTKPEVQEALQKAKELNEAMKALKTEINKKEQIKADSRYVNADSGLQANYNSALNYGSQIIATTQPPELNKDVINRATQTIKTAENNLNGQSKLAEAKSDGNQSIEHLQGLTQSQKDKQHDLINQAQTKQQVDDIVNNSKQLDNSMNQLQQIVNNDNTVKQNSDFINEDSSQQDAYNHAIQAAKDLITAHPTIMDKNQIDQAIENIKQALNDLHGSNKLSEDKKEASEQLQNLNSLTNGQKDTILNHIFSAPTRSQVGEKIASAKQLNNTMKALRDSIADNNEILQSSKYFNEDSEQQNAYNQAVNKAKNIINDQPTPVMANDEIQSVLNEVKQTKDNLHGDQKLANDKTDAQATLNALNYLNQAQRGNLETKVQNSNSRPEVQKVVQLANQLNDAMKKLDDALTGNDAIKQTSNYINEDTSQQVNFDEYTDRGKNIVAEQTNPNMSPTNINTIADKITEAKNDLHGVQKLKQAQQQSINTINQMTGLNQAQKEQLNQEIQQTQTRSEVHQVINKAQALNDSMNTLRQSITDEHEVKQTSNYINETVGNQTAYNNAVDRVKQIINQTSNPTMNPLEVERATSNVKISKDALHGERELNDNKNSKTFAVNHLDNLNQAQKEALTHEIEQATIVSQVNNIYNKAKALNNDMKKLKDIVAQQDNVRQSNNYINEDSTPQNMYNDTINHAQSIIDQVANPTMSHDEIENAINNIKHAINALDGEHKLQQAKENANLLINSLNDLNAPQRDAINRLVNEAQTREKVAEQLQSAQALNDAMKHLRNSIQNQSSVRQESKYINASDAKKEQYNHAVREVENIINEQHPTLDKEIIKQLTDGVNQANNDLNGVELLDADKQNAHQSIPTLMHLNQAQQNALNEKINNAVTRTEVAAIIGQAKLLDHAMENLEESIKDKEQVKQSSNYINEDSDVQETYDNAVDHVTEILNQTVNPTLSIEDIEHAINEVNQAKKQLRGKQKLYQTIDLADKELSKLDDLTSQQSSSISNQIYTAKTRTEVAQAIEKAKSLNHAMKALNKVYKNADKVLDSSRFINEDQPEKKAYQQAINHVDSIIHRQTNPEMDPTVINSITHELETAQNNLHGDQKLAHAQQDAANVINGLIHLNVAQREVMINTNTNATTREKVAKNLDNAQALDKAMETLQQVVAHKNNILNDSKYLNEDSKYQQQYDRVIADAEQLLNQTTNPTLEPYKVDIVKDNVLANEKILFGAEKLSYDKSNANDEIKHMNYLNNAQKQSIKDMISHAALRTEVKQLLQQAKILDEAMKSLEDKTQVVITDTTLPNYTEASEDKKEKVDQTVSHAQAIIDKINGSNVSLDQVRQALEQLTQASENLDGDQRVEEAKVHANQTIDQLTHLNSLQQQTAKESVKNATKLEEIATVSNNAQALNKVMGKLEQFINHADSVENSDNYRQADDDKIIAYDEALEHGQDIQKTNATQNETKQALQQLIYAETSLNGFERLNHARPRALEYIKSLEKINNAQKSALEDKVTQSHDLLELEHIVNEGTNLNDIMGELANAIVNNYAPTKASINYINADNLRKDNFTQAINNARDALNKTQGQNLDFNAIDTFKDDIFKTKDALNGIERLTAAKSKAEKLIDSLKFINKAQFTHANDEIMNTNSIAQLSRIVNQAFDLNDAMKSLRDELNNQAFPVQASSNYINSDEDLKQQFDHALSNARKVLAKENGKNLDEKQIQGLKQVIEDTKDALNGIQRLSKAKAKAIQYVQSLSYINDAQRHIAENNIHNSDDLSSLANTLSKASDLDNAMKDLRDTIESNSTSVPNSVNYINADKNLQIEFDEALQQASATSSKTSENPATIEEVLGLSQAIYDTKNALNGEQRLATEKSKDLKLIKGLKDLNKAQLEDVTNKVNSANTLTELSQLTQSTLELNDKMKLLRDKLKTLVNPVKASLNYRNADYNLKRQFNKALKEAKGVLNKNSGTNVNINDIQHLLTQIDNAKDQLNGERRLKEHQQKSEVFIIKELDILNNAQKAAIINQIRASKDIKIINQIVDNAIELNDAMQGLKEHVAQLTATTKDNIEYLNADEDHKLQYDYAINLANNVLDKENGTNKDANIIIGMIQNMDDARALLNGIERLKDAQTKAHNDIKDTLKRQLDEIEHANATSNSKAQAKQMVNEEARKALSNINDATSNDLVNQAKDEGQSAIEHIHADELPKAKLDANQMIDQKVEDINHLISQNPNLSNEEKNKLISQINKLVNGIKNEIQQAINKQQIENATTKLDEVIETTKKLIIAKAEAKQMIKELSQKKRDAINNNTDLTPSQKAHALADIDKTEKDALQHIENSNSIDDINNNKEHAFNTLAHIIIWDTDQQPLVFEVPELSLQNALVTSEVVVHRDETISLESIKKKMTLTDELKVNIVSLPNTDKVADHLTAKVKVILADGSYVTVNVPVKVVEKELQIAKKDAIKTIDVLVKQKIKDIDSNNELTSTQREDAKAEIERLKKQAIDKVNHSKSIKDIETVKRTDFEEIDQFDPKRFTLNKAKKDIITDVNTQIQNGFKEIETIKGLTSNEKTQFDKQLTALQKEFLEKVEHAHNLVELNQLQQEFNNRYKHILNQAHLLGEKHIAEHKLGYVVVNKTQQILNNQSASYFIKQWALDRIKQIQLETMNSIRGAHTVQDVHKALLQGIEQILKVNVSIINQSFNDSLHNFNYLHSKFDARLREKDVANHIVQTETFKEVLKGTGVEPGKINKETQQPKLHKNDNDSLFKHLVDNFGKTVGVITLTGLLSSFWLVLAKRRKKEEEEKQSIKNHHKDIRLSDTDKIDPIVITKRKIDKEEQIQNDDKHSIPVAKHKKSKEKQLSEEDIHSIPVVKRKQNSDNQRYKTEESYF

SEQ ID NO: 3160 - protein, 189 aa, Staphylococcus epidermidis
NQLKGTCLNMRLNEKTIDRTVIYNGSIIDLEVHDVELPDGSTSKRELVFHHGAVAVCAITPENEVLLVKQFRKPADQPLLEIPAGKLEKGEDRKEAAIRELQEETGYIASDLQFVTNMYGSPGFSSEKLSIYFTDQLTVGETNLDDDEFVELHKVPLSQIDSLLKDNKIEDAKTIIALQHLLLNYNHSK

SEQ ID NO: 3161 - protein, 389 aa, Staphylococcus epidermidis
CQLKYIYTSKKGVPYMINQKRLLDCFLELVQIDSETGHEETIQPYLKDTFEKMGLHVIEDEASKNNRLGANNLICTLKSNISHQNVPKIYFTSHMDTVVPGKNIQPVVKEDGYVYSDGTTILGADDKAGLAAIIEAIKQIKESNLPHGQIQIIITVGEESGLVGAKAIDTRLLDADFGYAVDASKDVGTTVIGAPTQVKIYTTIKGKTAHASTPKKGISAINIASKAISRMKLGQVDALTTANIGKFHGGSATNIIADEVTLEAEARSHDDQSINKQVKHMKETFETTANELGGQAEVLVEKSYPGFEVSEADKVTQYAISSALALGLKGDTCIAGGGSDGNIMNQYGIPSVILGVGYENIHTTSERIAIKDMYMLTRQIIKIIELVAE

SEQ ID NO: 3162 - protein, 633 aa, Staphylococcus epidermidis
RGIKMSDRFIKFNDEQLDAKQVMMLQDLARLLLKNEQTQVKIQKFPYYNPYSNTLIASWFWSHRPKHIEQAGLKTDVLLATYGYLNMDLSIINQVLHNNDFEHPKFFHQLFKLLEDVRIFEHIRQQRPSTTKMIDLRIETRLSFTESQINFYKTKTVYTDLLFLYLEHAFLSQNFFNIPSIHPAFDDILVHMYQYLPNIFQNQTSEDNMYLAERIMYQVDDLLKEDMLNEYYYLPQKLYEDIYADSFEDLKRTDASNTDGKDNQQTDEDVETAEAETKAADSESKGGAYLEMELHEGENSEVMADNDTAREGDSTDDMTDMMTKKGKGSENTLDHDEGGFIGQNQAFALKGINKDVSIEWNIPDITPQNVIDYQYSKNDVQFEIKDLIQIIKKTIDREHEDERHNLTKGRLQKDLINWFIDDQFKLFYKKQDLSKTFDATFTLLIDASASMHDKMDETIKGVVLFHETLKSLNIKHEILAFNEDAFEADQRQQPNIIDEIINYNYSIFEKEGPRIMTLEPQDDNRDGVAIRIASERLLQRSHEQRFLIVFSDGEPSAFNYSQDGILDTYEAVERARKFGIEVFNVFLSQEPITEDIEQTIHNIYGQFALFVEGVEHLPSHLSPLLKKLLLKSL

SEQ ID NO: 3163 - protein, 138 aa, Staphylococcus epidermidis
RGVKVMAKIYFDAATKGNPGRSACAIIIKENSQRYTFTHDLGKMDNHSAEWAAMLHALEHARELKVSNALLYTDSKLIEDSMMQGKVKNAKFKVYFENIEILEQSFDLMFVRWIPRKQFFFCLSTCSTNTIPTYITII

SEQ ID NO: 3164 - protein, 252 aa, Staphylococcus epidermidis
LTKKESQMSKEQERLQKRIANSGYTSRRKAEVLITEGRVKVNGQTVTELGSKVMPSDLVEVDGIKIEQEDKIYILFYKPTQVITSVSDDRGRRVVTDYFDDLESRIYPVGRLDYDTSGVLLLTNDGEFTNLMTHPRYHIKKKYVAKLKGYLMREEIKQLEKGIELEDGYTQPAQVKIKKQDKEKNTTLVEITISEGRNRQVRRMFEYFGHQVNKLTRIQFGPIDLKGLNAGEGRVLTPHEVKILRHLAENGK

SEQ ID NO: 3165 - protein, 329 aa, Staphylococcus epidermidis
FRRKSTRGGFIMSKNKKQSLQSAHQKPLLKRMWEHKVLYLMILPCLLFFLIFNYIPMTSLVLAFKDFRFDTGIIGGDWKGLYYFKRFFSDPRCIQIIMNTLIISGMKLILALPFPIILAIMFNEIKDSKLGKIRGLFQGVLYIPHFLSWVVVISIFKKLLAPDDGLMNQLIHQFGGDGSTYFMMNPEYFHTIMFSSYIWKNVGWDSIIYFAAIMSINPEIYESAAIDGANRFKQIIHITLPMLTPTIVILFIISLGDILKAGFDQIYLLKTPGNANVSEILDTFVIRTGIEQGDFSYAIAISLLQGVIGLIAVVIINKFADKKLDTSLY

SEQ ID NO: 3166 - protein, 81 aa, Staphylococcus epidermidis
LGGKISMAEVKVPELAESITEGTIAEWLKNVGDNVDKGEAILELETDKVNVEVVSEEAGVLSEQLAEEGDTVEVCQAVAVV

SEQ ID NO: 3167 - protein, 138 aa, Staphylococcus epidermidis
RLMNSLTSSTTCSGLKIKVSNEVEKKMSDVSLKLSAKDIYEKDFEKTMARGYRREEVDAFLDDIITDYQKMADMNNEVVKLSEENHKLKKELEELRLRVATSRPQDNKNFSSNNSSSASNNVDILKRISNLEKAVFGK

SEQ ID NO: 3168 - protein, 210 aa, Staphylococcus epidermidis
IMMNYPNGKPYSKNKPLDGRKSSPFSSNIEYGGRGMTLEKDIEQSNTFYLKSGIAVIHKKPTPVQIVNVHYPKRSKAVINEAYFRTPSTTDYNGVYNGYYIDFEAKETKNKTSFPLNNIHAHQVEHMKNTYHQKGIVFLMIRFKSLDEVYLLPYSKFEKYWQRYINNIKKSITVEEIRKNGYHIPYQYQPRLNYLKAVDKLILDESEDRV

SEQ ID NO: 3169 - protein, 618 aa, Staphylococcus epidermidis
MTKNKKEFTEAPVNFGANLGLMLDLYDDYLQDPSSVPEDLQVLFSTIKTGEAHIEAKPTTDGGGSQAGDSTIKRVMRLIDNIRQYGHLKADIYPVNPPERQNVPKLEIEDFDLDKETLEKISSGIVSEHFKDIYDNAYDAIVRMERRYKGPIAFEYTHINNNKERVWLKRRIETPYKASLNDNQKKELFKKLAHVEGFEKYLHKNFVGAKRFSIEGVDTLVPMLQHTITLAGNEGIKNIQIGMAHRGRLNVLTHVLEKPYEMMISEFMHTDPMKFLPEDGSLELTSGWTSDVKYHLGGVKTTNSYGIEQRISLANNPSHLEIVAPVVAGKTRAAQDNTHQVGAPSTDFHKAMPIIIHGDAAYPGQGINFETMNLGSLKGYSTGGSLHIITNNRIGFTTEPIDGRSTTYSSDVAKGYDVPILHVNADDVEATIEAIEIAMEFRKEFHKDVVIDLVGYRRYGHNEMDEPSITNPVPYQNIRKHDSVEILYGKKLVDEGIISEDEMNEVIDGVQKEMRTAHDKIDKNDKMNNPDMEKPESLQLPLQSDTKDFSFDHLKEINDAMLDYPKDFHVLKKLNKVLEKRREPFEKEEGLVDWAQAEQLAFATILQDGTSIRLTGQE

SEQ ID NO: 3170 - protein, 76 aa, Staphylococcus epidermidis
QVKNSERGTFSHRHAVLHDEDNGNTFTPLHHVPQQQATFDIHNSPLSEAAVVGFEYVYNVENKGNFNIWEAQYGDF

SEQ ID NO: 3171 - protein, 302 aa, Staphylococcus epidermidis
CKKKLVIKEMKKLQMNKLINIINTSLNKSIQSSPLKTNLEESMKYSLNAGGKRIRPVILLLTLKMLNKDYQQGLNSALALEMIHTYSLIHDDLPAMDNDDYRRGKLTNHKVYGEWKAILAGDALLTKAFELVSNDTTIEDSVKVSIIKRLSKASGHLGMVGGQALDMESEGKSIRLETLESIHETKTGALLNFSVMAAVDIAQVEQNIAKNLDEFSHHLGMMFQIKDDLLDVYGDESKLGKKVGSDIVNHKSTYVSLLGKEGAEEKLNNHQYLAMNCLNQISDQYDTSELSDIVDLFYNRDH

SEQ ID NO: 3172 - protein, 563 aa, Staphylococcus epidermidis
GCDEFMLQTLSIKQFAIIDELDINFSDGLTVMSGETGSGKSIIIDAIGQLIGMRASSDYVRHGEKKAIIEGIFDIDESKDAINILESLAIDVDEDFLLVKREIFSSGKSICRINNQIVTLQDLRKVMQELLDIHGQHETQSLLKQKYHLQLLDDYADNQYSDLLNQYQLSYNQYKNKRKELEELESADQALLQRLDLMKFQLEELTEASLKEGEVDQLESDIKRIQNSEKLNLALNNAHQVLTDESAIPDRLYELSNYLQTINDIVPEKFVRLKEDINQFYYLLEDAKHEIYDEMANTEFDEQVLNEYESRMNLLNNLKRKYGKDITELIAYQSKLANEIDKIENYEQSTSQLREEIKTLYNEVIDIGKKLSQERRRVARELRDHIVSEIQNLQMKDANLEISFKPLDEPTIEGIEFVEFLISPNRGEPLKSLNKIASGGELSRIMLALKSIFVKSRGQTAILFDEVDSGVSGQAAQKMAEKMRDIAQYIQVICISHLPQVASMSDHHLLISKASNADRTTTQVKELKDENKIDEIARMISGASVTELTRENAKEMIKQNHNI

SEQ ID NO: 3173 - protein, 115 aa, Staphylococcus epidermidis
RRRDDMIEKQDFNHIEDQLDQLASNKQLKTPEARELLDSYFDLIINYFKQINNIDEIHFNQLDTYPVVPMNFDERYHYMVARKHHFMGYRQMKTLKSELIKMNASYLIRKQRQQK

SEQ ID NO: 3174 - protein, 70 aa, Staphylococcus epidermidis
RRSDVIGKHFIITGATSGLGFAITNELLQRGAHVTILARNIDKFNRIKENYFKPEHINVIKCDLMQRKEY

SEQ ID NO: 3175 - protein, 246 aa, Staphylococcus epidermidis
EVVESMTNEILIVDDEDRIRRLLKLYLERESFEIHEARDGKEAYELALENNYACILLDLMLPEMDGIEVASKLREHKDTPIIMLTAKGEETNRVEGFESGADDYIVKPFSPREVVLRVKALLRRTQTANTEQSEPHARDIIEFSHLVIDNDAHRVLADDQQVNLTPKEYELLIYLAKTPNKVFDREQLLKEVWHYEFYGDLRTVDTHVKRLREKLNRVSSDAAQMIQTVWGVGYKFEVKPSDEPTK

SEQ ID NO: 3176 - protein, 474 aa, Staphylococcus epidermidis
TMSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNAYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEMSLLQFMNGSSLELGLTTHAHPSLSEVVMELGLKANGQAIHV

SEQ ID NO: 3177 - protein, 303 aa, Staphylococcus epidermidis
EVAETMKVSQDKSALVIRIISLIIIIGLVITIILPMINIFALAFNSGVDAQKGGITFYPRKFSLDNFKEIFKQGTLLNALFISIAKTVIGTILSVILTAMAAYVLTIKSLPFRRIISFFLVFTMLFSVGVVPLYILLNQLHLTDTFWVYILPSLYSVYNILIMRTFFNQLPSSVIEAARVDGCNDFQIFWKIVLPMSKPVVASITLFNAVSQWNDWFTGAFFVRNPNLKPLATVLQDMLTKQAAIADALKQKSGSYAMLDKLTITGDSMQMAMIVLLTIPVLFLFPFVQKHFVKGITIGSTKE

SEQ ID NO: 3178 - protein, 459 aa, Staphylococcus epidermidis
LLKDNLKRWFGFDEFKEGQEEIIDSVLHGRHTLGILPTGSGKSLCYQLPTYILEKPTLIISPLISLMDDQVMQMKLKGETHVACVHSGMDEVEKRDNIKRLSKSRFIYLSPEYILQPHNFKYIAHINFGLIVLDEAHCLSEWGYDFRPHYALVGKIIHHFNSATVLALTATAPPQLETDLSHILSLKLNVVQKSMNRENISLQHYNFNDDEGKIEWLLPFLSNSGPTIIYVSSKKRCLELAQMIYDSGYLTGIYHGDLSYQERQTVQQQFFNNDIPVIVATSAFGMGINKKDIRTVIHFHLSSSPSNYLQEIGRAGRDGKQSQAISLFQPDDSFILETLLFTDIITDDDITMFETGNHLPDEKEKILSTLNIQFTFSQLKDIFHQSYQRKRLGYMRMMGYTNLDQCRRKYLLEFFGEHPQSPKQCCDQDSRLEPIQILNRKKVKRKLSFNEKLYNLFET

SEQ ID NO: 3179 - protein, 415 aa, Staphylococcus epidermidis
TMEDIYKLIDDINLQKIENLDSRVNEALSSNNDDALFILGETLYNFGLTPQGLEVFRTLYHKYPDESELLIYFIEGLMSENQTDEALEYLAQVEPSTEKLMLEADLYQQINMLEVAIDKLQEALDLEPNDPIIHFALAELLYYDGQYLRATREYETVLETGEYEVNGVNIFSRMADCSLQSGNYSDAISLFDEINEEEMNSEDYFKKSIAYEKNDLTQEAIKIMQTLLSKDPDFIQGYFYLQSLFENEKNYPDAIETGKEGLRLSQFYKELMVSTGSLEIEHGDANEGVELLKQALEVDNAYHEPLLILSDLYRNEEDYESIIQLLTYVDEEDLDPIFMWHLAYAYGQEERDKEAQHFFELAYPTLQTQVEFLSDYYFYLLEIGQKEKAILILNQLLEIDPSNENWHDESMRLQI

SEQ ID NO: 3180 - protein, 147 aa, Staphylococcus epidermidis
QIMDLNFDLYMNDVVEQARNEIEHAGYQQLTSAEDVDQVLQQKGTSLVMVNSVCGCAGGIARPAATHALHYDKLPQRLVTVFAGQDKEATQQAREYFEGYAPSSPSFALIKDGKITEMIERHQIEGHDVMDVINQLQALFDKYCEER

SEQ ID NO: 3181 - protein, 176 aa, Staphylococcus epidermidis
NLMDQSLMDYYYQFHKHQHYFLCHDILEDAWKSQNTFSKHDAVVSLILFATANYHYRRGNLKGALKSFEKALLTINHAKDDTQLHLNINEFKQLIVKMIEAVKLQKQFTPLQLPIEPEFQTLIKRKYPDYLFTSQIIKEPYIVDHHIKRDRTEVIKNRERALFHRQYRNKSNKKDQ

SEQ ID NO: 3182 - protein, 223 aa, Staphylococcus epidermidis
NNKEGYQIMSSINIALDGPAAAGKSTIAKRVASRLSMIYVDTGAMYRAITYKYLQNGKPENFDYLINNTKLELTYDEVKGQRILLDNQDVTDYLRENDVTHHVSYVASKEPVRSFAVKIQKELAAKKGIVMDGRDIGTVVLPDAELKVYMIASVAERAERRQKENEQRGIESNLEQLKDEIEARDHYDMNREISPLQKAEDAITLDTTGKSIEEVTNEILSLL

SEQ ID NO: 3183 - protein, 443 aa, Staphylococcus epidermidis
KREEVYPMTKPIVAIVGKPNVGKSTIFNRVVGERVSIVEDTPGVTRDRIYSSGEWLTHEFNIIDTGGIEIGDAPFQTQIRAQAEIAIEEADVIIFMVNVREGLTQSDEMVAQMLYKSKKPVVLAVNKVDNLEMRNDIYDFYSLGFGDPYPISGSHGLGLGDLLDAVVENFNKESEDPYDEDTIRLSIIGRPNVGKSSLVNAILGEERVIVSNVAGTTRDAIDTEYSYDGQDYVLIDTAGMRKKGKVYESTEKYSVLRALKAIERSEVVLVVIDAEQGIIEQDKRVAGYAHEEGKAIVIVVNKWDTIEKDSKTMKKFTDDVRNEFQFLDYAQIAFVSAKEGLRLKTLFPYINQASENHKKRVQSSTLNEVVTDAISMNPTPTDKGRRLNVFYTTQVAIEPPTFVVFVNDVELMHFSYRRYLENQIRNAFGFEGTPIHIIPRKRN

SEQ ID NO: 3184 - protein, 60 aa, Staphylococcus epidermidis
DLLLHHVLKKYFVISKHLLKYHDIGSNVDAYEIDNNNPLMIDPLDFTHNLKVVCIHAIII

SEQ ID NO: 3185 - protein, 181 aa, Staphylococcus epidermidis
STYCGIKRCINISHTERRYTMTLSIIVAHDKQRVIGYQNQLPWHLPNDLKHVKQLTTGNTLVMGRKTFNSIGKPLPNRRNVVLTNQASFHHEGVDVINSLDEIKELSGHVFIFGGQTLFEAMIDQVDDMYITVIDGKFQGDTFFPPYTFENWEVESSVEGQLDEKNTIPHTFLHLVRRKGK

SEQ ID NO: 3186 - protein, 64 aa, Staphylococcus epidermidis
IACCSVLVSIAFTSLSYRLFIFIPISHVCIIAFISWEFEIINFSFEKTDNLDVGLSYYLFTLLF

SEQ ID NO: 3187 - protein, 270 aa, Staphylococcus epidermidis
FKSCMYSCYNNLVKYALTMQFDIEVDVMYEVKLDAFNGPLDLLLHLIQKYEIDIYDIPMKALTEQYMQYVHAMNQLEINVASEYLVMASELLMIKSKLLLPQTSIEEDIEEDPREDLVGRLIEYQNYKEYTEILNTMKEERDLYFTKHPTDLTHLETNESWDPNQTIDLTELIVAYQRVKNRVELNTPKSVEIKKETFTIQQATAQVTERLKQHESFNFFSLFTFHEPVEQVVTHFLAILEMSKSGIVNIKQTKQFDDIDIIRGVNYSIG

SEQ ID NO: 3188 - protein, 517 aa, Staphylococcus epidermidis
LKLCLIIKNIIFYYIYLRIEVLILSTKQKHIPCLITIFGATGDLSHRKLFPSIFHLYQQDNLDEHIAIIGIGRRDYNNEQFRDQVKASIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 3189 - protein, 275 aa, Staphylococcus epidermidis
IEECQLMSGLRSVTLGTNDLSKTKELFNHIIGLQHSTKNEHAIRFGDANLSPGTRVHFVEVPEEDYKNLHIDSVGLRTPSDSGLVEYQNIFDKFNISYSSITELNGLKHFTFEDHNQQKFDIYSNELNTGIGLGMPAFDSPVNPLHQVQGLGPVIIKVNELSVTTSILTQVFQLDLFAEYLPHEDAQQPIQVFRIGEGGLGGEIHLFESDEDIQMNTHGPIEQVEFSTNDTQLYLQAKNRLDEIGVPYQTLEQDTSESLRITENSGISFIYTLEK

SEQ ID NO: 3190 - protein, 296 aa, Staphylococcus epidermidis
LSVRQKSKGDETMTTILQLSDLHIGPPNDEKDLKTDDLIHHMMTHYQPDITVLTGDQIWSEGVIDSGRVYKKLMEYLNRYDTQIATTFGNHDTEGHLKRSDLRAIEDQYSTNYVQKNHSLIVDDKEAYTIEVVNNDTVTHVLYVIDGGDYNPFGIGDYDFIRPEHVNWLRETHQAYQTQFQHNFQHNLLFTHIPLQEYREVENIGEYHGIFNEPIACSKINSGLFSQMLLNGDIEGMFCGHDHDNDFTINLYGIRLSFGRIGGYNTYGDLQRGARLIELQPDAIYKSKVLEFDDRF

SEQ ID NO: 3191 - protein, 130 aa, Staphylococcus epidermidis
NMSRKDARVQAFQTLFQLEIKETDLTIQEAIEFIKDDHSDLDFDFIYWLVTGVKDHQIVLDETIKPHLKDWSIDRLLKSDRIILRMATFEILHSDTPKKVVVNEAVELTKQFSDDDHYKFVNGVLSNIND

SEQ ID NO: 3192 - protein, 305 aa, Staphylococcus epidermidis
TSYRFNRGANMNTIIEEYLNFIQIEKGLSNNTIGAYRRDLKKYKDYLEDNKISHIDFIDRQIIQECLGHLIDMGQSSKSLARFISTIRSFHQFALREKYAAKDPTVLIETPKYEKKLPDVLEIDEVIALLETPDLTKNNGYRDRTMLELLYATGMRVTEIIQLNVEDVNLMMGFVRVFGKGNKERIVPLGDTVIEYLTTYIETVRPQLLKQTTTQALFLNMHGKSLSRQGIWKIIKQYGLKANINKTLTPHTLRHSFATHLLKNGADLRAVQEMLGHSDISTTQLYTHVSKSQIRKMYTQFHPRA

SEQ ID NO: 3193 - protein, 69 aa, Staphylococcus epidermidis
HAVLAVQLLQIYMITMMKGIAYVILDDNQGTTEVPEELYEDMEDPLGGCPTDSIKIEDEPFDGDALKFE

SEQ ID NO: 3194 - protein, 322 aa, Staphylococcus epidermidis
GVVRMYNPFDEAYHGLCEEILEIGNRRDDRTHTGTISKFGHQLRFDLTKGFPLLTTKKVSFKLVATELLWFIKGDTNIQYLLKYNNNIWNEWAFENYVQSDDYHGPDMTDFGHRSQQDPEFNEQYKEEMKKFKERILNDDAFAKKYGNLGNVYGKQWRDWEDKNGNHYDQLKSVIQQIKTNPNSRRHIVSAWNPTEIDSMALPPCHTMFQFYVQEGKLNCQLYQRSADIFLGVPFNIASYALLTHLVAKECGLEVGEFIHTFGDAHIYSNHMDAIHTQLSRDSYLPPQLKINTDKSIFDINYEDLELINYESHPAIKAPIAV

SEQ ID NO: 3195 - protein, 234 aa, Staphylococcus epidermidis
IGGSNIMDLIQLKTRPVVIRRELFDHYSELGLDEQDLVILIKLLYASETSNKQPSIEFLQKGSTMEPRQITSVIQNLIQRELLELNVSKDEEGKFTEYMNLDPFYHKLNQLLKHQYLKHEEQDKKEQFKQLFQIVEQSFGRPLSPYEIETLNQWIDVDHHDLSVIQAALDEALSQNKLSFKYIDRILLNWKKNNVKTVDDSKKIREQFNKPKMKHVVKKVPKFDWLNGENPNDK

SEQ ID NO: 3196 - protein, 81 aa, Staphylococcus epidermidis
GGIFWLNDEYPIINGNQAAILGMHSIITRPIAVDKDTIENRPMMYIALSYDHRIIDGKEAVGFLKTIKELIENPEDLLLES

SEQ ID NO: 3197 - protein, 97 aa, Staphylococcus epidermidis
PGVSFLLSSYYVYRKRKNNRSLIYGLITGTIVMTIVLSILNYFVLLPLYGMIFNLGDVLNNVKIVIVSGVIPFNLIKGIIISIIFVLLFRRLRHIIK

SEQ ID NO: 3198 - protein, 366 aa, Staphylococcus epidermidis
KHIRIEVVIMTKIAYTGGGTVGHVSVNLSLIPTSIEKGHEAFYIGSKHGIEREMIESQLPDIQYYPISSGKLRRYLSFENAKDVFKVLKGILDARKILKKQKPDLLFSKGGFVSVPVVIAARSLKIPTIIHESDLTPGLANKISLKFAKKIYTTFEDTLTYLPKDKADFVGATVREDLKQGNKERGYQLTDFDKNKKVLLVMGGSLGSKKLNNIIRQNIEALLHDYQIIHLTGKGLVDDSINKKGYVQFEFVKDDLTDLLAITDTVVSRAGSNAIYEFLSLRIPMLLIPLGLDQSRGDQIDNAKNFESKGYGRHIPEDQLTEVNLLQELNDIELHRESIIKQMETYQESYTKEDLFDKIIHDALNK

SEQ ID NO: 3199 - protein, 332 aa, Staphylococcus epidermidis
RRISMQTIESIIIGGGPCGLSAAIEQKKKGIETLVIEKGNVVESIYNYPTHQTFFSSSDKLSIGDIPFIVEDSKPRRNQALVYYREVVKHHQLNIHPFEEVLTVKKINNKFAITTTKGVYECKYLTVATGYYGQHNTLEAEGAELPKVFHYFKEAHPYFNQNVVIIGGKNSAVDAALELEKAGANVTVLYRGEQYPKAIKPWILPNFESLVNHEKITMEFNATVTKITDHSVTYEKDGQLIEIDNDYVFAMIGYHPDYDFLKTIGIDIHTNEYGTAPVYNRETFETNVENCYIAGVIAAGNDANTIFIENGKYHGGVITQSILTKKQTPLET

SEQ ID NO: 3200 - protein, 377 aa, Staphylococcus epidermidis
LMMSYLFNNYKRDNIEFVDANQNELIDKDNNVYLDFSSGIGVTNLGFNMEIYQAVYNQLNLIWHSPNLYLSSIQEEVAQKLIGQRDYLAFFCNSGTEANEAAIKLARKATGKSEIIAFKKSFHGRTYGAMSATGQKKITDQFGPVVPGFKFAIFNDFNSFKSLTSNNTAAVIIEIIQGESGVLPADPLFMKQLNEYCKQKDILIIVDEVQTGIGRTGKLYAHEHYQLSPDIITLAKGLGNGLPIGTMLGKKNLGHAFGYGSHGTTFGGNRLSLVAANQTLSIINDADLLNDVQSKGQFLIENLRKSLVNKRNVIEVRGVGLMVGIEVTNDPSQVVREAKRMGLIILTAGKNVIRLLPPLTITKKQLEKGIEILTEII

SEQ ID NO: 3201 - protein, 236 aa, Staphylococcus epidermidis
RRVSLMSLISMIIYFVILMVIPMWAQHKVKSNYEKYSQVRSTSGKTGREVAEEILHANGIYDVDVVKGEGFLTDHYDPNKKVVCLSPANYDRPSVAGTAIAAHEVGHAIQHQQGYAPLRFRTALVPLANIGSSLSYIIIMVGIVLTALGSVFGSTVLWVGAGLMSLAVLFSIVTLPVEFNASSRAMKQITALNIVNEKEYKHAKKVLSAAAMTYVASTAVALAELARIILIARSSD

SEQ ID NO: 3202 - protein, 406 aa, Staphylococcus epidermidis
NKVRTTMSHEIFEQAKPILKKIQNKGFKAYFVGGSVRDYIMQRPIHDVDITTSATPDEIESIFDKTIPVGKEHGTINVVFQNDNYEITTFRSEDEYIDHRRPSEVYFVRDLYQDVQRRDFTMNAIAMDLNYRLYDYFNGQQDINNRVIRTVGVPSERFSEDALRIIRGLRFQSQLNFQIDSDTLHAMSSQISDIQYLSVERVVVELKKLIMGNNVKQSFEVMQNMKAFNYIPFFKSFEMSHLHIDEPITFELWIAILIVQQPKDIQLSTLKISNQEKATIKKWVTLIQTLPKIQSKQSLITLVYDYNLNDIEILLSLHHLLKQNGLTTANHLIINEISIREANEKLPIHCRKELAINGKDILNHTNKNSGPWLKDTLREIEIAVISNQIVNTKEEILEWVDAHVKI

SEQ ID NO: 3203 - protein, 69 aa, Staphylococcus epidermidis
LSILPKSWVNVYLCEFSLIIIAQALRPGFPLVAASKYILAITFTPLQNCLLTKMYLFYCIKLKRQSTKN

SEQ ID NO: 3204 - protein, 73 aa, Staphylococcus epidermidis
FKDGYYMLHETWKERTPIKKVEVTNTDAKKFTVADMLTIGKQYDVINETEEYYQIIDNSGLVGGYYKDYFKEI

SEQ ID NO: 3205 - protein, 93 aa, Staphylococcus epidermidis
VTIGGCHMEIIAISETPNHNTMKVSLSEPRQDNSSTTYTAAQEGQPEFINRLFEIEGVKSIFYVLDFISIDKEDNANWNELLPQIENTFAKSN

SEQ ID NO: 3206 - protein, 387 aa, Staphylococcus epidermidis
FKKGWAQMKIGITCYPSMGGSGIIATELGIKMAERGHEVHFITSNIPFRIRKPLPNMTFHQVEVNQYAVFQYPPYDITLSTKISDVIQEYDLDILHMHYAVPHAVCGILAKQMSGKNVKIMTTLHGTDITVLGYDHTLQNAIKFGIEQSDIVTSVSHSLAQQTYEIINTKKEIIPIYNFVRENEFPTRHNEELKDCYGISPEEKVLIHVSNFRKVKRIDTVIETFAKVHESIPSKLILLGDGPELIDMRHKARELDVETHVLFLGKQNDVSAFYQLSDLVLLLSEKESFGLTLLEAMKTGVLPIGSHAGGIKEVIRHEETGFIVDIGDSTQAAKYAIKLLSNPELYQKMQSQMLKDIEARFSSDLITDQYENYYRKMLEQGENNNES

SEQ ID NO: 3207 - protein, 337 aa, Staphylococcus epidermidis
HMFMKREVNEMTKLSYLEAIQNAQDLALNHFSNAFILGEDVGKKGGVFGTTKGLQSKYGDERVIDTPLAESNIIGTAIGAAMLGKRPIAEIQFADFILPATNQIISEAAKMRYRSNNDWNCPLTIRAPFGGGVHGGLYHSQSVESIFASTPGLTIVIPSSPYDAKGLLLSSIESNDPVLYFEHKKAYRFLKEEVPETYYTVPLGKADVKRPGEDITVFCYGLMVNYCLQAADILANDGIDVEVVDLRTVYPLDKATIIERSQRTGKVLLVTEDNLEGSIMSEVSAIIAENCLFDLDAPIMRLAAPDVPSMPFSPTLENEIMMNPEKIQDKMRELAQF

SEQ ID NO: 3208 - protein, 285 aa, Staphylococcus epidermidis
EAIMAKQIIVTDSTSDLSHEYLKQHNIHVIPLSLTIDGKSYTDQVDISSSEYIDHIENDADVKTSQPPIGRFIETYEQLAQDDVEIISIHLSSGLSGTYNTAVQASHMVDGNITVIDSKSISFGLGYQIKQIVELISQGTSTEEIVKEMTQLRDNLQLFVVIGQLNQLIKGGRISKTKGLIGNIMKIKPIGTLRDGKLELVHNSRTQNSSVQYLKKEITDFVKDHKIKSIGIAHANVKDFVDKIIKSFTESFDFSQFDINVTTPVISTHTGQGAIGLVVLRDTLN

SEQ ID NO: 3209 - protein, 208 aa, Staphylococcus epidermidis
GAPIMNRWKRISLLIVFTLIFGIIAFFHESRLGKWIDNEVYEFIYSSESFITTSIMLGVTKIGEVWAMVALSLLLVAYLMLKRFKIETLFFVIVMSLSSTLNPLLKNIFDRERPTLLRLIDISGFSFPSGHAMGSTSFFGSAIYVINRHDSGISKGVLIGLCALFILLISTSRVYLGVHYPTDIIAGIIGGVFCIVLSTLILKKQLAV

SEQ ID NO: 3210 - protein, 448 aa, Staphylococcus epidermidis
VITMTEYLSVSALTKYIKYKFDQDPHLQSVLIKGELSNFKKHSSGHLYFNVKDKESVISAMMFKGNASKLGFEPKEGDEVLIEARVSVYERRGNYQIYVNKMQLDGIGNLYQKLELLKKKLKKEGYFDQSNKKLIPKYPKKIAVLTASTGAAIRDIHSTINNRYPLVEQIQISTLVQGTQARQDIIEKIQYADSLDVDTIIVGRGGGSIEDLWNFNEEDVVKTIFNCQTPIISAVGHETDFTLSDFVADVRAATPTQAAVIATPDQYELLQQIKQYEYTLSRYIKQYIEHQKKQLNHISSYYKFKQPSLLYDQQIQKRDELERQLNHLLNTKVEKSKHHLKLLQQSFNFKNLNQQITQEKQSIYQLHSRLSKIMSNNITNLKTVLKNKLESLNNLSPTNTMLRGYAIVNKDNEVVTSTHKLNENDQISLTMKDGSVDATVKKVRCNDE

SEQ ID NO: 3211 - protein, 248 aa, Staphylococcus epidermidis
EEHMKNIIVIKLGGIAIENLNDAFIQQINAWHLENKKIIIVHGGGQVISNLLTKNNHSTIKIDGMRVTAKNDLPIIYDALINIVGHQLLERLKESNLEFFQFKEKIKELVSAEFLNKNIYGYVGKVKEINTMLLEKMLSRDIIPIITSLGVNEQGEYLNVNADHLATAIAKKLKVEKLVYMTDVPGVIEKDKTLATLTINEAKTKIENKIITGGMIPKIESAIQTLESGVESILIANNLQKGTIIRGD

SEQ ID NO: 3212 - protein, 222 aa, Staphylococcus epidermidis
GANMTNILIVEDEQNLARFIELELTHENYTVDIENDGKVGLDKALSKPYDLYILDLMLPNINGLEICRQIRQKTTTPIIIITAKSETYDKVAGLDYGADDYIVKPFDIEELLARIRAVLRRQPDKDVLDINGIIIDKDAFKVTVNGHQLELTKTEYDLLYVLAENRNHVMQREQILDHVWGYNSEVETNVVDVYIRYLRNKLKPFNKEKSIETVRGVGYVIR

SEQ ID NO: 3213 - protein, 204 aa, Staphylococcus epidermidis
IMNIIKGNIASPLGFSADGLHAGFKKKKLDFGWIVSEVPANVAGVFTTNKVIAAPLKLTKNSIEKSGKMQAIVVNSGIANSCTGKQGEKDAFKMQQLAANKLQIQPEYVGVASTGVIGKVMPMSILKNGFSKLVKNGNADDFAKAILTTDTHTKTCVVNEEFGSDTVTMAGVAKGSGMIHPNLATMLAFITCDANISSQTLQQV

SEQ ID NO: 3214 - protein, 746 aa, Staphylococcus epidermidis
GPRMTENKGSSQPKKNNNGKSNGKKNRNVKRTIIKIIGFMIIAFFVLLLLGILLFAYYAWKAPAFSESKLDDPIPAKIYDKNGELVKTLDNGQRHEHVNIKDVPKDMKNAVLATEDNRFYQHGALDYKRLFGAIGKNLTGGFGSQGASTLTQQVVKDSFLTQQKSIGRKAQEAYLSYRLEQEYSKDEIFQVYMNKIYYSDGVTGIKAAAKYYFNKDMKDLNLAEEAYLAGLPQVPNLYNIYNNPKEANNRKDTVLYLMHKHNRINDKQYADAKKIDLKANLVERTKKERQVTGNEKNPEYDSYVNFVQSELMNNKYFKDKNLGSVLQSGIKIYTNMDKDVQQTLQDRINNGSFYKNEDQQVGATILDSKTGGLVAISGGRNYKNVVERNQATDPHPTGSSLKPFLAYGPAIENMKWSTNHAIQDESSYWVDGSQFKNYDTKGHGTVSIYDALRQSFNIPALKTWQQVKSQAGNDAPQKFASKLGLDYSGKIGPSEVLGGSSSEFSPTQLASAFAAIANGGTYNNAHSIQKVVTHEGDTIEYEHTSHKAMKDYTSYMLAEILKGTFKAYGSAYGHGVSGVNMGAKTGTGTYGQEIYEKYNLPDNAAKDVWINGFSPEYTMSVWMGFNKVKQYGTNSFIGHSEQDYPQYLYEDVMSSISSKDGEDFKKPNDVQGSSPDSLSVSGHSDNNTTNRSVHGSSDTSSSSNGGSNSASSGNNSNSSNGTSQGNSGNAFTRLFNLNSIFDYKVS

SEQ ID NO: 3215 - protein, 225 aa, Staphylococcus epidermidis
KGIINMLEFKQVSKSFRDGNQMIQAVKPTDLKIIQGELIAIVGPSGSGKSTFLTMAGALQRPTSGNIYINNKNISILSEKQLSQIRINEIGFILQSTNLVPFLTIEQQFKLLGKYKKDTLSEDEYQKLVKQLNLSDITNQLPNQISGGQKQRVAIAKAIYTNPSIILADEPTASLDTNNAMAVMKILQKQTKERNKTCVIVTHDERLTHFCDKTYFMEDGVLSLQ

SEQ ID NO: 3216 - protein, 159 aa, Staphylococcus epidermidis
MKHMHRGTHEVERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 3217 - protein, 195 aa, Staphylococcus epidermidis
GVNMETTISKLNKHVEQLLKGINEYEPIEINSSLSHLLDMYSIPDEAKIACLTIDTSMRHLDAIGDNHLSKKAILIGDLLSAHFYTLLANIQDSAFQLAMSKAIVKINEDKSSINQNDLTDKELKDAILDIETLFPYLTINHFGSSVDKIKLFAELTSKYKDYHPEYLGKFNRYEIDKYIQEISKSYKKRGNENG

SEQ ID NO: 3218 - protein, 906 aa, Staphylococcus epidermidis
GADIMGIATFAVVDLETTGNQLDYDEIIQIGITFVRQNQVIDTYHSMIRTDLEIPPFIQALTSIEEEMLVQAPYFNEVADDIYQLIKDCVFVAHNISFDLNFIKKAFEKCNIQFKPKRVMDTLELFKIAFPTDKSYQLSALAESHHIPLNNAHRADEDATTTAKLMIKAFEKFEQLHLDTQKQLYYLSKNLKYDLYHILFEMVRNYQTKPPNNQFEQFEQIIYRKQIDLKKPAVNFDGTLKDLYKNVTQSLNLTYRPQQLYLAEIILDQLMHSDKAMIEAPLGSGKSLAYLLAATMYNIETGRHVMISTNTKLLQSQLLEKDIPLLNDVLDFKINASLIKSKNDYISLGLISQILKDDTNNYEVSILKMQLLIWITETNTGDIQELNLKGGQKMYVDQKIETYVPVRHDIHYYNYIKRNAQNIQIGITNHAHLIHSDSENTIYQLFDDCIIDEAHRLPDYALNQVTNDLNYSDVKYQLGLIGKNENEKLLKAVDKLEQRRILEKLDIAPIDVFGLKININELHDLNEQLFTTIYNIIQTSDVYDDDIHKYHYVYDFETGEILKDLRAIIDKLNKTIEIFNGMNHKTIKSVRKQLLYLHDKFKLIEQSIKDHHTSFISIKNLAQKSTIRLLVKDYDVKDILTKQVLEKFKSLTFISGTLTFNHSFKAFQNWFNEDIDFNTFEISTPLTSSNHTNVFVPNDVETYNYKNLDDYVASIVDYIVEYITVTQSKCLVLFTSYKMMHMVQDLLNELPELEDYVILTQQQNQNYKIVQQFNNFDKSILLGTSTFFEGFDFQANGLKCVMIAKLPFMNKHNIKYWLMDSEFTSTFKDYVLPDAVTRFRQGLGRLIRHEDDKGLIVSFDDRLVNSTYKSFFAQSLEHFKQRKGNIKQFNKLLNQIQRSIDNESKS

SEQ ID NO: 3219 - protein, 357 aa, Staphylococcus epidermidis
GESMELKTSYASDNYPIIVKHHAINSLERYIKNEEQRFFIIDKQVYNLFVDKLEALAQKFDAKCIVIPSGETSKSFEHYHRTIEYLLSHQLTRQTCIVAIGGGATGDFAGFIAATLLRGVSFVQVPTTILAHDSSVGGKVGINSEHGKNLIGAFYRPKAVIYDLDFLETLPYSEILSGYAEVYKHALLNGEKSTKNIESNFTSNKVLQALKNLDYYLFEGIKTKLNIVVEDEKEKGKRKFLNLGHTFGHAIEYEHKIPHGHAVMIGILYQFIVANHLFETNYNIQHYINYMKKLKYPLSIIKQLHFEDTYHFMLLDKKNDYNGIQMVLLKNLGKPVVTHVDKDTLLSAFEELQSYFK

SEQ ID NO: 3220 - protein, 301 aa, Staphylococcus epidermidis
LNLIGVKVLDVIKQIQQAIVYIEDRLLEPFNLQELSDYVGLSPYHLDQSFKMIVGQSPEEYARARKMTIAANDVVNGASRLMDVAKKYRYANSNDFANDFSDFHGISPIQATTKKDELKIQQRLYIKLSTTENAPYTYRLQETDDISLVGYSRFIPTEQLSNPFNIPDFLEDLLVDGYIKELKRYNDTSPYELFVVSCPLEQGLEIFVGVPSERYPSHLESRFLPGRHYALFNLQGEIDYATNEAWYYIESSLQLTLPYERNSLYVEIYPLDISFNDPFTKIQLWLPIKQEIYDLDEGYQN

SEQ ID NO: 3221 - protein, 411 aa, Staphylococcus epidermidis
GEIMKKILIANRGEIAVRIIRAAHDLGIQTVAIYSEGDKDALHTQIADEAYCVGPTLSKDSYLNIPNILSIATSTGCDGVHPGYGFLAENGDFAELCEACQLKFIGPSYQSIQKMGIKDIAKAEMIKANVPVVPGSEGLIQSIDDAKKIAKKIGYPVIIKATAGGGGKGIRVARDEKELETGYRMTQQEAETAFGNGGLYLEKFIENFRHIEIQIIGDTYGNVIHLGERDCTIQRRMQKLVEEAPSPVLSEDKRQEMGNAAIRAAKAVNYENAGTIEFIYDLDDNQFYFMEMNTRIQVEHPVTEMVTGVDLVKLQLKVAMGEALPFKQEDISINGHAIEFRINAENPYKNFMPSPGKITQYLAPGGFGVRIESACYTNYTIPPYYDSMVAKLIVHEPTREESIMTGIACFK

SEQ ID NO: 3222 - protein, 110 aa, Staphylococcus epidermidis
MYQIIKQLLEDIDEMNYRYQHVKINGGSFDFYKDVEPYVKNIDNHLEALNCYSKSITETQYMSQQKLDILILNIQKLSVDCHFPRTSRKLFVEKLKSAQYDLKNILSNYV

SEQ ID NO: 3223 - protein, 436 aa, Staphylococcus epidermidis
VNQMNNSEIININGPFKGEIEVPGDKSMTHRAIMLASLAKGISTIYEPLMGEDCRRTMDIFKLLGVTIEEQDNSIIINSPGYQNFITPHQVLYTGNSGTTTRLLAGLLSGLGIESVLSGDVSIGKRPMDRVMKPLLKMNANISGIDNNYTPLIIKPSTIKGINYQMEVASAQVKSAILLASLFSKEATTLTEFDVSRNHTETLFAHFNIPISIQGKTIQTIPYAIEHIQPRDFHVPGDISSAAFFIVAALITPGSDITIHNVGINPTRSGIIDIVKQMGGNIELSNVSKGAEPTASIHVKYTPNLNAVTIKGDLVPRAIDELPVIALLCTQASNSCIIKNAEELKVKETNRIDTTADMLNLLGFNLQPTHDGLIIHPSEFRSNATVDSQTDHRIGMMLAVASLLSSEPLKIEQFDAVNVSFPGFLPKLKLLENEGK

SEQ ID NO: 3224 - protein, 267 aa, Staphylococcus epidermidis
RMEIMVQTVYKNSDQTVFEDAKALFQLNKNILLKGPTGSGKTKLAETLSHVMKLPMHQVNCSVDLDTESLLGFKTIQTNEEGHQEIVFIDGPVIKAMKEGHILYIDEINMAKPETLPILNGVLDYRRQLTNPYTGEVIKAAPGFNVIAAINEGYVGTLPMNEALKNRFIVIEIDYIDGDILKTVIKEQSKLQDEQLIQDIVKFNEDLRTMTKQGQISEEAASIRALIDLSDLATVMPIERAVQRTIIDKLEDEREQQAILNAIELNF

SEQ ID NO: 3225 - protein, 224 aa, Staphylococcus epidermidis
MERILMISKKKALQMIDVIADMFPNAECELNHRNAFDLTIAVLLSAQCTDNLVNRVTQSLFRKYRTPEDYLNVSDEELQNDIRSIGLYRNKAKNIKKLCHSLIEQFNGQIPQTHKELESLAGVGRKTANVVMSVAFGEPSLAVDTHVERVSKRLGINRWKDSVRQVEDRLCDIIPRDRWNKSHHQLIFFGRYHCFARKPKCEICPLLNDCREGQKRHKAKIKEA

SEQ ID NO: 3226 - protein, 79 aa, Staphylococcus epidermidis
GVMMSKEKQSFEEMMKELENIVQKLDNEAVSLEESLDLYQRGMKLSANCDSTLKEAEKKVNELMQEEVGDKGNEETTDE

SEQ ID NO: 3227 - protein, 443 aa, Staphylococcus epidermidis
NLMIVSKRTFRSLYIPILIEQLFILIMGQADTLMLNSYSTDAVAASGMISQILMLITFLITIIHVGTNIRIVHLKEHQPSSISQEIYHNLLFNSIVSIVFTIVIGIAFELILRLFQVPQDIFKLTYQFGMIILSVLTLTTCHMYIGTVLRVMNHASSATRITIISNVTNIILNGIVLFIIPEYVGNPVLGVAVVTAFSRLLGCTLALIALIQIFRPFKHYFKLSWKKIYQVSTLGIPTAGEQISYNFAQTFTTAFIAMLGTQVIAAKSVSTVLSGLSFSCAMAFSAASQIYLGKFISRRRYRTLKKVVIKSIWFNITQSFMIMTCVFIGFIVCGRWITHDIQTYHLIIYYLVILFGLEPIRAINNLIVDLLNVTGDVRYPVTVSVVTTWLLLLPGSYLLGIHWRLGYTGIILVSIADEALRFIIMYLRWRNDRWQARMKQIGV

SEQ ID NO: 3228 - protein, 591 aa, Staphylococcus epidermidis
NLVMNRLNSVVIKLWLTIILIVATVLILLSVSLITFIQYYFTQETENAIKEDAKRISSLVEKSHNKTLAIQNSQTLIDGDGPGGLIIMKDMSEKPDSSYKDTKKQMFNEIKKSTKFKKVFKEGEYETQNITIKNKGNSQSYLLLGYPMKAQKGAQSHYSGVFIYKDLKSIEDTNNAITIIILITAIIFTIASTIFAFFLSNRITKPLRQLKTQAQKVSEGDYSQISTVATKDEIGDLSRAFNNMNVEIQEHIKAISSSKNIRDTLLNSMVEGVLGINNQREIILSNKMADDIMRHIDDFSKESIEQQIEATFESQQNEYLELEINTRYYVFISSYIDRIQTNGRSGIVMVIRDMTNEHNLDQMKKDFIANVSHELRTPISLLQGYTESIVDGIVTEPDEIRDSLAIVLDESKRLNRLVNELLNVARMDAEGLSVEKELQPIQHLLDKMESKYRMQSEELGLTMTFDSNNDEQLWNYDMDRMDQVLTNLIDNATRYTQAGDSIKISIDEDSDFNILTITDTGTGIAPEHLKQVFDRFYKVDAARKRGKQGTGLGLFICKMIIEEHGGRIDVESELGKGTSFIIRLPKSKQIS

SEQ ID NO: 3229 - protein, 328 aa, Staphylococcus epidermidis
NGWMHMSKYSQDVIRMLYEHQSNYISGQYIADQLNISRAGVKKVIDLLKEDGCDIKSINHKGHQLNSLPDQWYSGIVKPILDELGLFNHLEVYHTVDSTQLKAKRALVGNKDTFLILSDEQTEGRGRFNRNWESSKGKGLWMSLVLRPDVPFSMIPKFNLFIALGIRDAIQQFSNERVTIKWPNDIYIGNKKICGFLTEMVANYDEIEAIICGIGINMNHVESDFDEDIKDKATSIRMHSDSIINRYTFLTALLTQIIHRFDQFLHQTFESIREEYIHATNIWHRQLKFTENNHQFLGEAIDIDSDGFLIVKDEKGQLHRLMSADIDL

SEQ ID NO: 3230 - protein, 61 aa, Staphylococcus epidermidis
CKGIQTVHFLIITSARCTQNNYAVFSMKHSFNILIFCMYYSSLMRFSLTYIIIKNIRIHTE

SEQ ID NO: 3231 - protein, 130 aa, Staphylococcus epidermidis
TLHLKCKSLYFVIYYIRIAIKEYFYMKSMEQMQQEVDDYISQFKAGYFSPLANLARMTEEVGELAREINHRFGEKKKKDTEEDNTIKAELGDNLFVLLCIANSLNIDMTESFNDTMNKFNTRDKNRFERK

SEQ ID NO: 3232 - protein, 156 aa, Staphylococcus epidermidis
EMNFKEIKELIEILDQSSLTEINIEDNKGSVVNLKKEKETEIVTPQVTQQPTQPINHTHNETQQKPSHSSKDEQSSDNEYNTINAPMVGTFYKSPSPDEKAYVQVGDKVTNESTVCILEAMKLFNEIQAETTGEIIEILVEDGQMVEYGQPLFKVK

SEQ ID NO: 3233 - protein, 61 aa, Staphylococcus epidermidis
INIVCKLNVNNIYLILISLFSFLLIKDLKCCLINVLSLLFFEKLQTKNFDLRKLKFEKSLL

SEQ ID NO: 3234 - protein, 326 aa, Staphylococcus epidermidis
EEYVMKRLLIIHTGGTISMSQDQTNKVITNEENPISQHQNIISQYAEVDEINLLNIPSPHMTISNVVRLRDEIITYSKENIYDGFVITHGTDTLEETAFLIDLLIDIQEPIVITGAMRSSNEIGSDGLYNFISAIRVASSSEANHKGVMVVFNDEIHTARNVTKTHTSNINTFQSPNQGPLGVLTKNRVQFYHHPYRQTTYQYIDVNLRVPLVKAYMGMEDDVLSFYSQQHVDGIVIEALGQGNLPKSCLNGLQQCLKKNIPLVLVSRSFNGIVSPVYAYEGGGADLKNNGVIFSNGLNGPKARLKLLVGLSQDMTQNQLERYFEE

SEQ ID NO: 3235 - protein, 467 aa, Staphylococcus epidermidis
SYNVIELIKMEGMIVVSNNNFKDDFEKNRQSINPDEHQTELKEDDKTNENKKEADSQNSLSNNSNQQFPPRNAQRRKRRRETATNQSKQQDDKHQKNSDAKTTEGSLDDRYDEAQLQQQHDKSQQQNKTEKQSQDNRMKDGKDAAIVNGTSESPEHKSKSTQNRPGPKAQQQKRKSESTQSKPSTNKDKKAATGAGIAGAAGVAGAAETSKHHHNKKDKQDSKHSNHENDEKSVKNDDQKQSKKGKKAAVGAGAAAGVGAAGVAHHNNQNKHHNEEKNSNQNNQYNDQSEGKKKGGFMKILLPLIAAILILGAIAIFGGMALNNHNDSKSDDQKIANQSKKDSDKKDGAQSEDNKDKKSDSDKNADDDSDNSSSNPNATSTNNNDNVANNNSNYTNQNQQDNANQNSNNQQATQGQQSHTVYGQENLYRIAIQYYGEGTQANVDKIKRANGLSSNNIHNGQTLVIPQ

SEQ ID NO: 3236 - protein, 207 aa, Staphylococcus epidermidis
KCPVRFKKYFIELCLVRKKMVKTVYITGYKSFELNIYKDDAPEVYYLKQFIAHKLKHLLDEGLEWVLIQGQMGIELWSAEVVIELKKDFPDIKLGIITPFIGHTQRWNDKNQAKYTNIIQQADFTESIHHTEYMGAYQFKQADQFMLDHTDYTILIYDDEQEASPKYFKAMLVEFMEKTNYTCDIVTFDELTDFINDLQWSQDQSFE

SEQ ID NO: 3237 - protein, 262 aa, Staphylococcus epidermidis
EGQVNTSNDSSNESSQKDEAKEKETPKQSTPNSSESENTQDNSQQRINATPSARRHARKNGVDLSEVSGKGNDVLRKDDVENSQKSSSQTAKSESKSQNSGSKQSNNNPSKPVIREKMSRRKKTAAKKLLEVSNQTAMLTTFNEVDMTNVMDLRKRKKEQFIKDHDGTKLGFMSFFTKAAVAALKKYPEVNAEIDGDDMITKQFYDIGIAVSTDDGLLVPFVRDCDKKNFAEIEQEIANLAVKARDKKLGLDDMVNVSFTIN

SEQ ID NO: 3238 - protein, 307 aa, Staphylococcus epidermidis
SMEVTFFGTSAGLPTKERNTQSIALNLEPYSNSIWLFDVGEGTQHQILRHSIKLGKIDHIFITHMHGDHIFGLPGLLTSRSFQGGENKPLTIIGPKGIQNYIETSLQLSESHLNYPITYIEINQQLAYHHNGFTVQAEMLNHGIPSFGYRIEAPITPGTINVEALRGIGLEPGPKYQEVKLQETFEYKGLIYNSDDFKGKAKPGPIISIFGDTKPCENEYELAKNSDLMIHEATYIEGDKKLANNYHHSHIDDVFNLIKQANVNKSLITHISNRYNIDEVTSIYNELSLDQTSPHFYFVKDFDTFKI

SEQ ID NO: 3239 - protein, 67 aa, Staphylococcus epidermidis
LREVKAILTNTEQQAIQHIDQLMNIYCHQCPLKKHNRKTHGKTQAHHFCINECTVGKQIKQIGNELQ

SEQ ID NO: 3240 - protein, 64 aa, Staphylococcus epidermidis
IKKVLNVFYLMICLNLLNNSTNIMEMIMPLIKLKGMTPDTITIFTLLSTSPKLNIIPYNGSNTK

SEQ ID NO: 3241 - protein, 474 aa, Staphylococcus epidermidis
TREVSNMTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 3242 - protein, 1151 aa, Staphylococcus epidermidis
TKGVILMAINEQLDTLYKLKKELEKSNNRPLINTINQVIKKVYLNQYTATFVGHFSAGKSTLINLLLEQDILPSSPVPTTSNTAIVSVAKEDEIIANLTQQQYTKLKTYNDVKQMNRQNVDVESIEINFPSNKFNLGFTFQDTPGVDSNVATHQSSTEQFMYTSNLLFYTVDYNHVQSALNFKFMKRINEVGIPIIFVINQIDKHNEEEITFETFKSRVEKSIKDWDIKLQDTYYVSKFDHPQNEIDKLSNFLVFMDQHRESTEDYVNRTIQFITDAQYIYIQNEMQSILDTLQINEEQFEEAYIQFQQNQEVSAEAQLLNDSNQLFNYLKQKRKDILDNAYIMTYDMRESLRNYLESMATDFKVNGFFNKRKKKEEEQIKRLNEATTQLQEKVNQQVRQPLREDMSFLTRFINKHAVNEKILNQEYDVVPSLISELYQTQTSISNTYVLTFSDEVIKALNKKIENESTPLFEEAVNHVQVNELSSDENEDRYEYDRYIELNTLKDSLTSHNYKHYYIHLDDSLDKLIGRTETHFELKQENSTAYHRKHETQHRNEFVTSNQDIKRALDIVKDVPLFDRTKQDITDTILRLDNQITKVGVFGTFSAGKSSLINALLGDNYLVSSPNPTTAATTELSYGKESQITLKSKEQLLEEVNHVLEFYEISFNTLDNFIKSDLEKLKSKLEKNQLAFISAIEKHYEMYTSMLEHSLIHTVSLEEIKKWSAEDEYATFVKTVHLKLPLDWLKGKIIIDSLGLHSNNQRHTNETEQILTSSDLILYVTYFNHSFTDNDKAFIEHMKDMNQLNENQAFKMIINAVDLAEDKQDIQAVEDYVADALGQVNLHSDIYSVSSRQSLNGNNIGINELRESIQYFAKVESRTILEQQMTYQLQQMNNSFKKMIKDFHDDNAKLSARQHKLNHYKNQTLLNQELIDTTAQRTFNEVEEQVYHLNERLKLQLLDEVKSVFNSQMTQNNDFNEEKKISTKIYLDQIHQRLFLEQSLITERIKKYFNSQLEEQILPVMKKLNQIHVIINAKFNVEPSLVDTALLQIELNSMLQSLPKQLTKRKIVNPKSQKDIQVHIANQTLELLQDDLNSLRRQLNDYIHEMTQLAEHQFQMLETSIQQQIDELLSFTIDDTLIQQLELKTTQLDNIL

SEQ ID NO: 3243 - protein, 155 aa, Staphylococcus epidermidis
KQLLVEEHFMMNGYEAYMKELAQQMRAELTDNGFTSLETSDDVNQYMQNIDNDDTTFVVINSTCGCAAGLARPAAVAVAEQNEVKPDHKVTVFAGQDKEATQTMRDYIQQVPSSPSYALFKGQHLVHFIPREHIEGRDINDIAMDLKDAFDDNCQ

SEQ ID NO: 3244 - protein, 258 aa, Staphylococcus epidermidis
INIFKKLAKVIKKEVMKMAENQAKKEQVHTVFQNISQKYDRLNNIISFEQHKVWRKHVMSTMNVQKGSKALDVCCGTADWTIALSEAVGSKGQVTGLDFSENMLEVGKQKTASLENIQLVHGDAMNLPFDDNSFDYVTIGFGLRNVPDYLSALKEMHRVLKPGGMVVCLETSQPTLPLFKQIYSLYFKFVMPIFGKMFAKSKEEYEWLQQSTFNFPDKQTLKGLFFEAGFNDIIVRSFTGGVAAMHLGYKENSSSKGD

SEQ ID NO: 3245 - protein, 61 aa, Staphylococcus epidermidis
VHSLTDTPLFIFTDNIITYFVTLEYDEHSYKDRYLFVVDLLFIRKIKHTDWLNILYVLKCN

SEQ ID NO: 3246 - protein, 353 aa, Staphylococcus epidermidis
GASFMFLAWNEIKRNKIKFSLVIGILVLISYLLFLLSGLANGLIKMNTEGIEKWNADAIILKKEANQTVEQSLFNISKVQNTYEKSTTLKQQGVIISNHHREENALLFGVTHKSFLIPPIIKGHQVESSNEIVIDQTLADKGFKIGDILSLSQSDEKLKVVGIVESAKYNASPVLFSNNQTIEKLNPKLSKDKTNAIVIKDSNWKNHKLNKDLESISISQFIKNLPGYKAQNLTLNFMIVFLFIISATVIGVFLYVITLQKTHLFGVLKAQGFTNCYLAKMVFAQTFILSLIGTIIGFLLTLLTGTFLPPVVPIHFNLLTMLIYGIVLIIISLLGSLFSVLSIIKINPLKAIG

SEQ ID NO: 3247 - protein, 183 aa, Staphylococcus epidermidis
TIALDNIAILEALLYTSGDEGLEQKQIIDILDINLNQLEDLVSKYHSHGLTIQRYGSTYVLTTKKETFTYIEQLVKEKSKMKLSQAAMETLSIIAYNQPLTRGDIEMIRGINSDGAVKTLIARGLVEAKDVDHSRSHHLITTDLFLNVFGIENLDALPTTEEDEAEMDEFFSNLVNQKGESNE

SEQ ID NO: 3248 - protein, 387 aa, Staphylococcus epidermidis
FNKLKGDSVMFQLLAVCPMGLEAVVAKEIQELGYDTQVENGRIFFEGDESAIVRCNLWLRTADRIKIVMGRFNATTFDELFEQTKSLPWETVIDKEGNFPVQGRSVKSTLYSVPDCQAITKKAIVERLKHAHQEKGWLSETGAKYPVEVAILKDNVLLTIDTAGSGLNKRGYRIAQGEAPIKETLAASLIRLANWNGNTPLIDPFCGSGTIAIEACLIAQNIAPGFNRDFVSEQWNMMPPNIYDKFRDEADQLADYDKDIQVYASDIDPEMIEIAKRNAEEVGLGDIIQFNVKDVNTLSIDTDKPVALVGNPPYGERIGDREEVEEMYRYIGTLLKQHPHLSAYILTSNKEFEYLVNRKATKRRKLFNGYIECTYYQYWGKKQSNKN

SEQ ID NO: 3249 - protein, 215 aa, Staphylococcus epidermidis
YGLSEVMNISHRNRFIANPGCYATATELALYPLISNHLIRVDSIIVDAKSGLTGAGKKLNQSSHYVNVNNNYVTYKLNKHQHIPEIVQTLQFFNKSLQNIQFSTSLIPVNRGIVATIYTRLENGVKINQIESTYKDVYKNKPFIRIKDGLPQLNEVIGTNYTDIGFVYNETTGVLTISSVIDNLIKGAAGQAIQNMNLMFNFDETDGLILAPLYI

SEQ ID NO: 3250 - protein, 357 aa, Staphylococcus epidermidis
KAYSSKQDLTISLYVALQVALLQCTLAIKKTVLAKVINVAKLNINNEIKKVEKRLEEAIISSDQTLQEASFHLLSSGGKRVRPAFVILSGQFGSNNKPSEDTYRVAVALELIHMATLVHDDVIDKSDKRRGRLTISKKWDQSTAILTGNFLLAMGLKHLSEISDTRVHSTISKSIVDVCRGELFQFQDQFNSNQTITNYLRRINRKTALLIQLSTQVGAITSNASNDVIRKLKMIGHYIGMSFQIIDDVLDFTSSEKKLGKPVGSDLMNGHITLPVLLEMRKNKTFKDKISQLNPDSPQHAFETCITIIRQSESIEQSKQISEKYLNKAINLIDELEDGPNKELFRKLIKKMGSRNK

SEQ ID NO: 3251 - protein, 187 aa, Staphylococcus epidermidis
MNDSLIRIKQNFIEYILFNYRFKSRITVWVLNYLKANQDKLNNVHFVNSKINNHYTLEIAEVDATASAIQLSKDNKSYINTNQIFNYIANHTLRLDIQIHFANCHIRESRLDDLILMQLIHSPSYSSYVQDLYSISMDKRKQTFIIQTLQNNIDLSLQMNEPDYFYQLTQILNVLKSKDIQSTLHER

SEQ ID NO: 3252 - protein, 314 aa, Staphylococcus epidermidis
GRCPMILTLTLNPSVDISYPLDQFNLDTVNRVSQTSKTAGGKGLNVTRVLSEFGEDVIASGFLGGALGQYIEEQIETTRIKQAFFKIKGETRNCIAILHEGQQTEILEKGPTIELKESEEFKSHLLKLFKETDVAVMSGSLPKGLNTDYYADIVRLAKEQGILTILDSSGQSLEEVLISNVKPTVIKPNIDELSQLLNYKVTNDIKELKAAVSQPIFNDIEWIIVSLGSEGAFAKHNQKFYKVNIPNIKVVNPVGSGDSTVAGIASGLIHQQTDEELLKKANAFGMLNAMEQQTGHINTDKFDEIFKQIEVIEV

SEQ ID NO: 3253 - protein, 221 aa, Staphylococcus epidermidis
GGNTVGQKINPIGLRVGVIRDWEAKWYAEKDFASLLHEDLKIRKFIDNELKEASVSHVDIERAANRINIAIHTGKPGMVIGKGGSEIEKLRNKLNTLTDKKVHINVIEIKKIDIDARLVAENIARQLENRASFRRVQKQAITRAMKNGAKGIKTQVSGRLGGADIARAEQYSEGTVPLHTLRADIDYAHAEADTTYGKLGVKVWIYRGEVLPTKNTSEGGK

SEQ ID NO: 3254 - protein, 83 aa, Staphylococcus epidermidis
GRDTMADNNNQNGQDATQQFINILKSFKWRIIGFLAFLIIAILFLTLGFWKTILIIVLCLIGIGIGYIKDRTQDFLNFLNRWS

SEQ ID NO: 3255 - protein, 187 aa, Staphylococcus epidermidis
LSWFLVFFYNVNTFHNDTVFFWFSSYYFTFFTFVFTCDNFYVVTFFDMHVGTSLNYVNLFDWYYSTSGASDTIFMKFPSRNSRATGPKIRVPRGPLSSRMITHAFSSNLIYEPSSRRTPDFVRTTTAFTTSPFLTTPPGVAFLTVHTIISPMFAVLRPDPPNTLIVRTSRAPELSATFKRVSCWIIR

SEQ ID NO: 3256 - protein, 171 aa, Staphylococcus epidermidis
RRDTFMARREEETKEFEERVVTINRVAKVVKGGRRFRFTALVVVGDKNGRVGFGTGKAQEVPEAIKKAVEAAKKDLVVVPRVEGTTPHTITGQYGSGSVFMKPAAPGTGVIAGGPVRAVLELAGITDILSKSLGSNTPINMVRATINGLQNLKNAEDVAKLRGKSVEELYN

SEQ ID NO: 3257 - protein, 163 aa, Staphylococcus epidermidis
FIRTAIMNEAFIFRRTIIMRQTFMANESNIERKWYVIDAEGQTLGRLSSEVAAILRGKNKVTYTPHVDTGDYVIIINASKIEFTGNKEQDKMYYRHSNHPGGLKSISAGELKRTNPERLLETSIKGMLPSTRLGEKQGKKLFVYGGAEHPHAAQQPENYELRG

SEQ ID NO: 3258 - protein, 340 aa, Staphylococcus epidermidis
RGGTMKAIGFKSSFQLDEGNCFEEFNFDIPHPSGHELLVKVQSISVNPVDTKQRTMPVDKAPRVLGFDAVGVIEKIGDQVSMFQEGDVVFYSGSPNQNGSNEEYQLIEEYLVAKAPTNLKSEQAASLPLTGLTAYETLFDVFGISKEPSENKGKSLLIINGAGGVGSIATQIAKFYGLKVITTASREDTIKWSVNMGADVVLNHKKDLSQQFKDNHIEGVDYIFCTFDTDMYYEMMVNLVKPRGHIATIVAFNSQQDLNLLKSKSVTFTHEFMFSRPLHHTDDVIKHHEYLKDITEKVEQGYYQPTTTKVIDGLDVDSLYEAHQILESHSMIGKLVINLK

SEQ ID NO: 3259 - protein, 123 aa, Staphylococcus epidermidis
INMARIAGVDIPREKRIVISLTYVYGIGTSTANKIVEEANVSADTRVKDLTDDELGRIREVVDGYKVEGDLRREQNLNIKRLMEISSYRGIRHRRGLPVRGQKTKNNARTRKGPVKTVANKKK

SEQ ID NO: 3260 - protein, 279 aa, Staphylococcus epidermidis
ATMALKKYKPITNGRRNMTTLDFAEITKTTPEKSLLQPLPKRAGRNNQGKLTVRHHGGGHKRQYRVIDFKRNKDGITAKVDSIQYDPNRSANIALLVYADGEKRYIIAPKGLQIGQTVESGAEADIKVGNALPLQNIPVGTVIHNIELKPGKGGQLARSAGASSQVLGKEGKYVLIRLRSGEVRMILSTCRATIGQVGNLQHELVNVGKAGRSRWKGVRPTVRGSVMNPNDHPHGGGEGRAPIGRPSPMSPWGKPTLGKKTRRGKKSSDKLIVRGRKKK

SEQ ID NO: 3261 - protein, 654 aa, Staphylococcus epidermidis
IMNFNQFINKQNIIMTEDEHNVYDFLKHHNPNWSSNYIDHLLDGRDKVSQRLITSLHRENLVKSRDHSRILNRHQFAGYGVNVIAILEIYFPTSNIYLYAPITGMHAFDRIDVEGPFYFKNLSKEDDFERVLHPNQILDWILIEDENLNNEASVQFRNDLNNSAANMTFALSFQHYTMRNERAPLYNLIKNANDSYLRSEQSVIEGHPLHPGAKLRKGMNAEENFMYSSEFGNVIHLRAVFIHKSISRIQSSNVDYNVAVKQMFPDLIKTLEKEFGEDFNLQNYHLMMVHPWQIKHILQSDYRDELNEKLILISNHSVPYYAGLSFRTLVPKQPDLSPHIKLSTNVHITGEIRTLSEQTTYNGPLVTQILREIMSKDEDFSHYQSTYIDENAGIHFYNRNDNEAIQTDRSEQLGTLFRNNLYQFISNETVPVIPSSLVATYPYNTEAPICTLIKTYQNTYQYKNYEEAAKQWIKDYSKALLGLVIPLYSKYGISLEAHLQNSVATFNKDGSLNMIYIRDFEGLRIDNEQLNNAGFTTRHFHEKSRILTNSKTSVFNKMFYSTVQNHLGELVITIAKYSNSKVLEQEIWQIISQTVEDIFNHMTHISKQHLNNIKRTIFASEIDYKCVTTMRLEDQAHEYTYIKVHNPLHRKNDL

SEQ ID NO: 3262 - protein, 123 aa, Staphylococcus epidermidis
LMGYRKLGRTSDQRKAMLRDLATSLIVSERIETTEARAKEVRSVVEKLITLGKKGDLASRRNAAKTLRNVEILNEDDSTQTALQKLFGEIAERYSERQGGYTRILKVGPRRGDGAESVIIELV

SEQ ID NO: 3263 - protein, 192 aa, Staphylococcus epidermidis
EASQNVVLQKKTEEVDGYNAIQVGFEDKQAYKKGSKSNKYANKPAEGHAKKADTAPKRFIREFRNVNVDEYEVGQEVSVDTFETGDIIDVTGVSKGKGFQGAIKRHGQGRGPMAHGSHFHRAPGSVGMASDASKVFKGQKMPGRMGGNTVTVQNLEVVQVDTENSVILVKGNVPGPKKGLVEITTSIKKGNK

SEQ ID NO: 3264 - protein, 123 aa, Staphylococcus epidermidis
RMIQQETRLKVADNSGAREVLTIKVLGGSGRKTANIGDIIVCTVKNATPGGVVKKGDVVKAVVVRTKSGVRREDGSYIKFDENACVIIRDDKGPRGTRIFGPVARELREGNFMKIVSLAPEVL

SEQ ID NO: 3265 - protein, 109 aa, Staphylococcus epidermidis
GGAHMHIKKGDNVKVIAGKDKGKEGKVVATEPKKDRVVVEGVNVVKKHQKPTQLNPEGGILETEAAIHVSNVQLLDPKTNEPTRVGYKTVDGKKVRIAKKSGEEIKANN

SEQ ID NO: 3266 - protein, 60 aa, Staphylococcus epidermidis
VMAKLQITLTRSVIGRPETQRKTVEALGLKKTNSSVVVEDNPAIRGQINKVKHLLTIEEK

SEQ ID NO: 3267 - protein, 73 aa, Staphylococcus epidermidis
SMAKQDVIELEGTVLDTLPNAMFKVELENGHEILAHVSGKIRMNYIRILPGDKVTVKMSPYDLSRGRITYRYK

SEQ ID NO: 3268 - protein, 66 aa, Staphylococcus epidermidis
KEANKVAKTSMVAKQQKKQKFAVREYTRCERCGRPHSVYRKFKLCRICFRELAYKGQIPGVRKASW

SEQ ID NO: 3269 - protein, 194 aa, Staphylococcus epidermidis
LMYNLKLTFAKEVTCEVKRLKNFILGLLIVAIVGFLLFMYIDDSRIQSYQDYFLQFNWFQPLLIGLAGLLILIGLILVLSIFKPTHRKPGLYKNFDDGHIYVSRKAVEKTIYDTIAKYDQVRQPNVVSKLYNKKNKSFIDIKADFFVPNHVQVKSLTESIRADIKSNVEHFTEIPVRKLEVNVRDQKTSGPRVL

SEQ ID NO: 3270 - protein, 174 aa, Staphylococcus epidermidis
FKNKGECIMAVDNNKAKQAYDNQTGVNEQERKEQQQAQNNQPQFENKLTFSDEVVEKIAGIAAREVKGILDMKGGFTDSFTNAFSNGNNVTTGVSVEVGEKQAAVDLKVILEYGESAPKIFRKVTDLVKEQVKYITGLEVVEVNMQVDDVMTKKEWQQKNEKDNKENNEREGLK

SEQ ID NO: 3271 - protein, 256 aa, Staphylococcus epidermidis
EVNKSMNKYDRLDEITKLVNKRGSVRTNEIVEDLNVSDMTVRRDLAELEEKGVLTKIHGGARSNSAFQYKEMSHQEKHTRFIEEKRFIAKNAVDLIEDGDTIFLGPGTTVQKLAEEINHYSLTIITNCLPVFNILIKKQTLHFRVYLLGGEMRDLTEAFVGEMTNQLLSQLRFSKMFFSSNGVKDGLAMTSSIEEAYTQQIALSHSLEKYLLIDSSKIGKDDFSSFCELRELNAVLTDNNDLEKKEKIESYVEVIS

SEQ ID NO: 3272 - protein, 168 aa, Staphylococcus epidermidis
FRCKDLKALFQKHMCLITLIQKRRLIMTIIIGSDVDGKRLKELIKDYLEDNDYDVLDVTEGKDLDFVDSTVSVAKEVQKSDDNLGIAIDAYGAGSFIVATKIKGMIAAEVSDERSAYMTRSHNNARMITMGAEIVGDTLAKNVAKEFVNGHYDGGRHQIRVDMLNKMC

SEQ ID NO: 3273 - protein, 290 aa, Staphylococcus epidermidis
YTVNLNYCRMFSDIKILGVVDVNGSNPIIEFKDVSFQYQSDAAFTLNRVSFSIPAGQWTSIVGHNGSGKSTIAKLMVGIEEPSEGQILFQNLPVDSQNKREVRKHIGIVFQNPDNQFVGSIVKFDVAFGLENQLVPYKEMVSKVNQVLTEVDMINKADDEPHSLSGGQKQRVAIAGVLALNPDVLILDEATTMLDPHGKSSLLNLVNEVKVNNHVTIISITHDLDEAMHADQIIVLNKGTVFKQGTPQDIFKCEDALISVGLDLPFPLKMNRLLGFDSTYVTYEGLIKKL

SEQ ID NO: 3274 - protein, 326 aa, Staphylococcus epidermidis
FMTKSQQKVSSIEKLSNQEGIISALAFDQRGALKRMMAEHQSETPTVEQIEQLKVLVSEELTKYASSILLDPEYGLPASDARNNDCGLLLAYEKTGYDVNAKGRLPDCLVEWSAKRLKEQGANAVKFLLYYDVDDTEEINIQKKAYIERIGSECVAEDIPFFLEVLTYDDNIPDNKSAEFAKVKPRKVNEAMKLFSEDRFNVDVLKVEVPVNMNFVEGFSEGEVVYTKEEAAQHFRDQDAATHLPYIYLSAGVSAELFQDTLKFAHDSGAQFNGVLCGRATWSGAVKVYIEEGEQAAREWLRTVGFKNIDDLNTVLKTTATSWKNK

SEQ ID NO: 3275 - protein, 591 aa, Staphylococcus epidermidis
IIQKRELTPMNKLIAWIEKGKPFFEKISRNIYLRAIRDGFIAAIPIILFSSIFILITYVPNVFGFTWSKTMEGILMKPYNYTMGIVGLLVAGTTAKSLTDSYNRKLDKANQINFISTMMAAICGFLFLAADPVKDGGFSSAFMGTKGLLTAFISAFITVIVYNFFVKRNITIKMPKEVPPNISQVFKDIFPLSAVILILYALDLLSRAIVHTNVANAVLKVFEPLFTAADGWIGVTLIFGAFAFFWFVGIHGPSIVEPAIAAITYANLETNLHLIQAGEHADKVITPGTQMFVATMGGTGATLVVPFMFMWLTKSKRNKAIGRASVVPTFFGVNEPILFGAPLVLNPVFFIPFIFAPIVNIWIFKFFVDVLNMNSFSIFLPWTTPGPLGIVMGTGFAFWSFVLAILLIVVDVIIYYPFLKVYDEQVLEEELGNKEANNELKEKVSANFDTKKADAILATAGASEADTDDTSSVDETTSTSSTDTISEQTNVLVLCAGGGTSGLLANALNKAAEEYEVPVKAAAGGYGAHMDIMKDYQLIILAPQVASNFEDIKQDTDRLGIKLAKTEGAQYIKLTRDGEAALEFVKQQFNN

SEQ ID NO: 3276 - protein, 134 aa, Staphylococcus epidermidis
RRQNLMARKQVSRKRRVKKNIENGVAHIRSTFNNTIVTITDEFGNALSWSSAGALGFKGSKKSTPFAAQMASETASKTAMEHGLKTVEVTVKGPGPGRESAIRALQSAGLEVTAIKDVTPVPHNGCRPPKRRLV

SEQ ID NO: 3277 - protein, 248 aa, Staphylococcus epidermidis
KQMKKPDIQQLKDIVNNSNQIVFFTGAGVSVASGIPDFRSMGGLYDEISKDGQSPEYLLSIDHLHDNKESFINFYHERLLIADKKPNIVHQWIAQLENQQKSLGVITQNIDGLHEDAGSHNIDELHGTLNRFYCINCYEEYSKSYVMTHHLKYCEKCGNVIRPDIVLYGEMLNQKTVFKALDKIQHADTLIVLGSSLVVQPAAGFVSEFKGDNLVIINRDATPYDHTASLVIHDDMTNVIEEILNSNS

SEQ ID NO: 3278 - protein, 354 aa, Staphylococcus epidermidis
CMANVRVNLSKIKYNAKVLQSLLERRHIHFTPVIKCVAGDKRIVSSIKSLGITHFAESRLDNIEQLKDLDITFTLLRPTVEADLEKMISRVEMSIQTELTTIKKLNTLAKSLDIKHQIMLMVDWKDGREGVLTYDVVRYVQEVLRLSHIQLVGLAFNFMCFKSEAPNEKDVRMINKFIHNVENETHFKFRIISGGNSSMLPQTLYNHLDKINDLRIGEALLRGIDTTTNHSINSLYQNAIVLEAEIIEIKPRLYQKNNQSYLQAIVDIGYLDTFIEGIKPLGNDIRILGASSDHLMIDLNNQDHYQIGDKLQFSLNYEALSQSMYMKNLTKLYSSDSKIESLVQNFDMHIYSQC

SEQ ID NO: 3279 - protein, 78 aa, Staphylococcus epidermidis
NVKNWVVKQMKAKEIRDLTTSEIEEQIKSSKEELFNLRFQLATGQLEETARIRTVRKTIARLKTVAREREIEQSKANQ

SEQ ID NO: 3280 - protein, 150 aa, Staphylococcus epidermidis
GGAEMKLHELKAAEGSRRVRNRVGRGAATGNGKTSGRGQKGQKARSGGKVRPGFEGGQLPLFRRLPKRGFTNINRKEYAIVNLDQLNKFEDGTEVTPALLVESGVVKNEKSGIKVLGNGSLDKKLTVKAHKFSASAAEAIDAKGGAHEVI

SEQ ID NO: 3281 - protein, 128 aa, Staphylococcus epidermidis
HSKERSIEMISKIDKNKVRLKRRARVRTKLSGTAEKPRLNVYRSNKHIYAQIIDDVKGVTLAQASSQDKDIANTSASKVDLATTVGQAIAKKANDKGIKEIVFDRGGYLYHGRVKALADAARENGLEF

SEQ ID NO: 3282 - protein, 94 aa, Staphylococcus epidermidis
LKEEVTKVSERNDRKVYVGRVVSDKMDKTITVLVETYKTHKLYGKRVKYSKKYKTHDENNSAKLGDIVKIQETRPLSATKRFRLVEIVEESVII

SEQ ID NO: 3283 - protein, 123 aa, Staphylococcus epidermidis
VEEEILMEAKAVARTIRIAPRKVRLVLDLIRGKNAGEAIAILKLTNKASSPVIEKVLMSALANAEHNYDMNTDELVVKEAYANEGPTLKRFRPRAQGRASAINKRTSHITIVVSDGKEEAKEA

SEQ ID NO: 3284 - protein, 615 aa, Staphylococcus epidermidis
LHLLLWELALSVFHSFFISYNVFRIWRRAIMNHKEWLLADKNIQYRTINAMIKEHIVSEGMRIKEGTCKVEIFLNNHLLSLKVARKSALKRYVFTGDIVLKNKKLSQSIESLEELLQILTEIFHINISKRLYDELIHSRDSLYETYKHFYNRQTLIHQSMKFSKLPDSINFIAWLQHLQDSGITDDLSYSESLVIEGHPTHPLTKTKLPLSTNELKLYAPEFEKVIPLNIMLIEKNHVVTTAINDDQNFILNQVIPEYRDRLKCYLEPLRLNLNDYRVMLIHPWQYDHTIGEQFEEWIAKKILLPTPFTVESKATLSFRTMDLIHTPYHVKLPVNVQATSAVRTVSSVTTVDGPKLSHALQGLLQEFPELQVAMEPYGAYAHTASDLSKQLALIIRQKPTIYDYGCTVVTASLVNPNPIDNQAVVDSYLKWIENEITLDHIKHFIAIYTQTLVTPLIAYIQNYGIALEAHMQNTIVNLGPNYKMKFIVRDLGGSRIDLNTLKQKVPQIDVTNESLIADTIEEVIAKFQHAVIQNQLAELIHHFNQYDEVIEEELFEIVREEIEMAIDNDKPHAEKLKKILFGSTITVKALLSMRMENKVKKYLNTKLDNPIKKEV

SEQ ID NO: 3285 - protein, 112 aa, Staphylococcus epidermidis
KLIWVCGVKLHAHNKKGGAQMARSIKKGPFVDDHLMKKVEAQDGSEKKQVIKTWSRRSTIFPNFIGHTFAVYDGRKHVPVYVTEDMVGHKLGEFAPTRTFKGHAADDKKTRR

SEQ ID NO: 3286 - protein, 440 aa, Staphylococcus epidermidis
CKRWSTRGDLMFQTFVRFFTTKEVRNKIFFTLAMLVIFKIGTYIPAPGVNPEAFNHPQGSQGATELLNTFGGGALKRFSIFAMGIMPYITASIVMQLLQMDIVPKFTEWAKQGEMGRRKINNVTRYFAIILAFIQSIGMAFQFNNYLKGQLIIEKSVMSYLLIAVVLTAGTAFLIWLGDQITQFGVGNGISLIIFAGILSTLPSSLEQFAQSVFVGQDDTSLAWLKILGLIVALILLTVGAIFVLEAKRKIPIQYAKKQSAQRLGSQATYLPLKVNSAGVIPVIFAMAFFLLPRTLTLFFPKAEWAQNIADTANPSSNIGMIIYVVLIIAFAYFYAFVQVNPEKMADNLKKQGSYVPGIRPGEQTKKYITKVLYRLTFVGSIFLAAIAILPIIATKFMGLPQSIQIGGTSLLIVIGVAIETMKTLEAQVTQKEYKGFGGR

SEQ ID NO: 3287 - protein, 96 aa, Staphylococcus epidermidis
GGARIMEARDVLKRPVITEKSSEAMAEDKYTFDVDTRANKTQVKIAVEEIFDVKVDSVNIINYKPKKKRMGRYQGYTNKRRKAIVKLKEGSIDLFN

SEQ ID NO: 3288 - protein, 121 aa, Staphylococcus epidermidis
KQQLHHGKTNNVREDIQMNRDEVQLLGFEIVAYAGDARSKLLEALNAAKDSEFDKAEQLVEEANECIANAHKAQTNLLAQEAKGEDIAYSITMIHGQDHLMTTLLLKDLMKHLIELYKKGS

SEQ ID NO: 3289 - protein, 222 aa, Staphylococcus epidermidis
IICRRAFMNIILMGLPGAGKGTQASEIVKKFPIPHISTGDMFRKAIKDETDLGKEAKSYMDRGELVPDEVTVGIVKERISEDDAKKGFLLDGFPRTIDQAESLNQIMSELDREIDAVINIEVPEEELMNRLTGRRICEKCGTTYHLVFNPPKVDGICDIDGGKLYQREDDNPETVSNRLSVNVKQSKPILEYYNNKGVLKNIDGSKDIDEVTNDVIDILDHL

SEQ ID NO: 3290 - protein, 275 aa, Staphylococcus epidermidis
SCIRSGIMKNKLIIGRYLPMQSIIHQLDPRAKLIFVFFFIILIFFCHSLGTYAWLFLFIILFIKLARIPFWFLIKGLTPIFFFLVFTFSMHVLFTNGGIVLFQWKFITIESSGVMEGIYISLRLIFIVMIATIMTLSTSPIDLTDAFEKLFAPLKVIKVPVHQLSMMMSIALRFIPTLMDELEKIILAQKSRGSEISSGSLITRIRAFIPIMIPLFISAFQRAEELAIAMEVRGYDINIKRTSYRLLHWQYKDTLTVLLLIPIATILFILKFSGV

SEQ ID NO: 3291 - protein, 140 aa, Staphylococcus epidermidis
ESERRQQSMTMTDPIADMLTRVRNANMVRHEKLELPASNIKKEIAEILKSEGFIKNVEYVEDDKQGVIRLFLKYGQNNERVITGLKRISKPGLRVYAKANEVPKVLNGLGIALVSTSEGVITDKEARKRNVGGEIIAYVW

SEQ ID NO: 3292 - protein, 288 aa, Staphylococcus epidermidis
KIMSIQFNQVSYIYQQGTPYEFEAIKNVSLTLEQGKYYAIIGQTGSGKSTLIQHLNALLKPTTGSVNINGLEVTNKTKDKHLRHIRKEVGVVFQFPESQLFEDSVEKEIEFGPKNFNMNLKNVKDKAFQLLLELGFSRNVMSSSPFQMSGGQMRKIAIVSILAMDPQVIILDEPTAGLDPNSKHQVMSLIKKIQIEENKTIILVSHDMDDVARYSDEVVVMNKGTIVEKSNPRNLFNQKTQLLKWHIELPKVVKLQKDIEKKYNMLFPKLATNEEEFVKLYKEWHHEE

SEQ ID NO: 3293 - protein, 185 aa, Staphylococcus epidermidis
IIRRCHNMSRVGKKIIDIPSDVTVTFDGSHVTVKGPKGELERTLNERMTFKQEENTVEVVRPSDSKEDRTDHGTTRALLNNMVLGVSQGYEKTLELVGVGYRAQMQGKDLVLNVGYSHPVEIKAEEGITFAVEKNTTVKVSGVSKEQVGAIASNIRSVRPPEPYKGKGIRYQGEYVRRKEGKTGK

SEQ ID NO: 3294 - protein, 348 aa, Staphylococcus epidermidis
MKRRCVFMRLSLLDYVPLFEGRTPNDALKHSIKLAQHAEKLGYLRYWVAEHHQVYSVVSSAPEIIMMSILEHTQHIRVGSGGVMLPHYSPYKVAEQFKIMEARHPQRIDMAIGRSPSFKNVNAALNENKNEKLPFNTQITDLLKYFNNDTTQDHRFKSLLATPMVTSFPQLYILGMSNRSAKLAAQRGLPFVIARMGQSETDLHEAISTYRKYFKAYHGEINNAKPYVILATFVVTASNLSRVKQLLHTLQLWLMRINYLNQPKSYPSIETAQNKHYSQRELEKLEKMKSKIIYGMPNDVAEQLTLLHQQFKVDEIIILPHVFGEDARMELIELIANELIPSCSRDEF

SEQ ID NO: 3295 - protein, 215 aa, Staphylococcus epidermidis
KAKGGNCIMANYDVLKVDGSKSGSVELNDAVFAIEPNNSVLFEAINLQRASLRQGTHAVKNRSAVRGGGRKPWRQKGTGRARQGTIRAPQWRGGGVVFGPTPRSYAYKMPKKMRRLALRSALSFKVQENSFTIVDTFGFEAPKTKEFKNVLTTLEQPKKVLVVTESEDVNVELSARNIPGVQVTTAQGLNVLDLTSADSVIITEAAAKKVEEVLA

SEQ ID NO: 3296 - protein, 185 aa, Staphylococcus epidermidis
LKGGSTLNRLKEKFNTEVTENLVKKFNYSSVMEVPKIEKIVVNMGVGDAVQNSKVLDNAVEELELITGQKPLVTKAKKSVATFRLREGMPIGAKVTLRGERMYEFLDKLIAVSLPRVRDFQGVSKTAFDGRGNYTLGVKEQLIFPEIDYDKVTKVRGMDIVIVTTANTDEEARELLTNFGMPFRK

SEQ ID NO: 3297 - protein, 268 aa, Staphylococcus epidermidis
ILRILVEIAYQGNQFLGFQIQQQGRTVQQQFEKILKRMHKHHVRIHPSSRTDRGVHAYQQFFHFDTELNIDNKQWQYAMNRALPDDIYVKNVRNVDEYFHCRYDCVGKRYRYKVYQGNHRNPFKSGTETFVYETLDYDKMNKAAQEFIGTHDFTGFCSQKTEVESKVRTLYQSEIVATKEGFDYVVTGSGFLYNMVRVLVAFLIEVGKGKHEPNDVPKLLEDKNRNNVPLTAPPDGLYLEKIYLSPEELIQEYGKDIKIHYKKSLEKH

SEQ ID NO: 3298 - protein, 347 aa, Staphylococcus epidermidis
HNSINYYYKDDDDMNNEQIVFNKVPDGMPQDDTFKYEDIDVIEPSENELQLKTLYISVDPYMRGRMTNADSYIDPFKQGEPFNGHTVSKVLKSKDSNFDEGDIVVGMLPWRKINTVNSEYVNKVPTSDVPLHLYLSVLGMPGQTAYHGLLDIGQPKEGETVVISAASGAVGSVVGQIAKLKGCRVVGIAGGDKKVNYLKNELRFDAGIDYKKDNFPEALKEAVPNGIDVYFENVGGYIGDEVFKHLNTHARIPVCGAISSYNHPEKDIGPRIQQTLIKNQAMMRGFIVAEFADGFKEASKQLAQWVQENKIKTQVSVEDGFDKVPQAFRNLLTGDNFGKQVIKVASE

SEQ ID NO: 3299 - protein, 411 aa, Staphylococcus epidermidis
SILMIMIIIINEKDRWNLMAKYFFSSSFLLFLGNWIGQVGLNWFVLTTYHNAVYLGLVNFCRLIPILLLSVWAGSIADKYDKGLLLRITITSSFIITALLCLLTYSLNSIPIFIILLYATFRGILSAVETPVRQAVLPDLSSKISTTQAVSFHSFIINICRSIGPAIAGGLIAVYHTPTTFLAQAVCYFIAAVLCIPIHFEVILSQKEGKALPLKVVLNYFKSNLEGSQIFITSIIIMATGFSYTTVLPVLTNHIFPGQSQVFGIAMTFCAIGGIVATIVLPSILKHLSTVKMYYLSSILFGIALLGIIIHHLVVMFICITLIGLFSQWARTTNRVYFQHSVKDCDRGKVLSIIMMDRGMIPLGSLIMSFFADMFGILTTFTIMGISTISISLIFYIIQRISNMEESNNES

SEQ ID NO: 3300 - protein, 179 aa, Staphylococcus epidermidis
NVLIGGIKMKIAIGCDHIVTDTKMEVSQHLKSQGHEVIDVGTYDFTRTHYPIYGKKVGEKVASGEADLGVCICGTGVGISNAANKVPGVRTALVRDMTSALYSKEELNANVVSFGGKVAGELFIFDIVDAFIEAEYKPTEENKKLIAKINHLEAHNNDQADPHFFDEFLEKWNKGEYHD

SEQ ID NO: 3301 - protein, 292 aa, Staphylococcus epidermidis
RGLMMKSKFTILLFTIFSTTVLVLVIIYNKTQSQSYISTHYSNNKIKTTATLFLHGYGGSERSETFMVKQALNKNVTNEVITARVSSEGKVYFDKKLSEDAANPIVKVEFKDNKTGNFKENAYWIKEVLSQLKSQFGIQQFNFVGHSMGNISFAFYMKNYGDDRHLPQLKKEVNIAGVYNGILNMNENVNEIIVDKQGKPSRMNAAYRQLLSLYKIYCGKEIEVLNIYGDLEDGSHSDGRVSNSSSQSLQYLLRGSTKSYQEMKFKGAKAQHSQLHENKDVANEIIQFLWET

SEQ ID NO: 3302 - protein, 191 aa, Staphylococcus epidermidis
RYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 3303 - protein, 149 aa, Staphylococcus epidermidis
RRKIIMLLPKRVKYRRQHRPKTTGRSKGGNYVTFGEYGLQATTTSWITSRQIESARIAMTRYMKRGGKVWIKIFPHTPYTKKPLEVRMGAGKGAVEGWIAVVKPGRILFEVAGVPEEVAREALRLASHKLPVKSKFVKREELGGETNES

SEQ ID NO: 3304 - protein, 255 aa, Staphylococcus epidermidis
MIEIEKPRIETIEVSEDAKFGKFVVEPLERGYGTTLGNSLRRILLSSLPGAAVKYIEIEGVLHEFSAVDNVVEDVSTIIMNIKKLALKIYSEEDKTLEIDVKDEGEVTASDITHDSDVEILNPELKIATVSKGGHLKVRLVANKGRGYALAEQNNTSDLPIGVIPVDSLYSPVERVNYTVENTRVGQSSDFDKLTLDVWTNGSITPQESVSLAAKIMTEHLNIFVSLTDEAQNAEIMIEKEEDQKEKVIEISMEE

SEQ ID NO: 3305 - protein, 135 aa, Staphylococcus epidermidis
KEEITLAQVEYKGTGRRKNSVARVRLVPGEGNITVNERDVRDYLPFESLILDLNQPFDVTETKGNYDVLVNVHGGGFTGQAQAIRHGIARALLEADPEYRGSLKRAGLLTRDPRMKERKKPGLKKARRSPQFSKR

SEQ ID NO: 3306 - protein, 288 aa, Staphylococcus epidermidis
KGVLYMTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDTKF

SEQ ID NO: 3307 - protein, 506 aa, Staphylococcus epidermidis
IDKSKFKGEKFMSEEMNDQMQVRRQKLQELIDLGIDPFGHRFNRSSTSSELKEQWDQFSKEELHEKEDESHVSIAGRLMTKRGKGKAGFAHIQDLKGQIQIYVRKDQVGDDQFNIWKMADLGDIIGVEGVMFKTNTGEISVKAKSFTLLSKSLRPLPDKFHGLQDIEQRYRQRYLDLITNEDSTQTFINRSKIIQEMRNYLNKQGFLEVETPMMHQIAGGAAARPFVTHHNALDATLYMRIAIELHLKRLIVGGLEKVYEIGRVFRNEGVSTRHNPEFTMIELYEAYADYHDIMDLTENMVRHIAQEVFGSAKVQYNDEEIDLESSWKRLHIVDAVKEVTGVDFYNVNSDEEAIRLAKEHDIEITENMKYGHILNEFFEQKVEETLIQPTFIYGHPIEISPLAKKNPNDERFTDRFELFIVGREHANAFTELNDPIDQRQRFEAQLVEKEQGNDEAHDMDEDYIEALEYGMPPTGGLGIGIDRLVMLLTDSPSIRDVLLFPYMRQK

SEQ ID NO: 3308 - protein, 64 aa, Staphylococcus epidermidis
RTRSSDFNGNVAKAGTDIKENDELIIRFGQKLVTVKVTGLSDHATKENAKGMYDLIKEERINEE

SEQ ID NO: 3309 - protein, 99 aa, Staphylococcus epidermidis; identical to SEQ ID NO: 3070

SEQ ID NO: 3310 - protein, 269 aa, Staphylococcus epidermidis
FKMPNVVGVQFQKAGKLEYYAPNQLDVKVGDWVVVQSKRGIEIGHVKFPLREVDVEDVTLPLKNIIRKMNEDDQETYYRNERDANDALELCKKVVKDQQLDMRLVNCEYTLDKSKVIFNFTADDRIDFRKLVKVLAQNLKTRIELRQIGVRDEAKLLGGIGPCGRSLCCSTFLGDFEPVSIKMAKDQNLSLNPTKISGACGRLMCCLKYENDYYEEARTQLPDVGDMIQTPDGHGKVIGLNILDISMQVKIEGLEQPLEYKMEEIEVLN

SEQ ID NO: 3311 - protein, 204 aa, Staphylococcus epidermidis
EMSTFITFEGPEGAGKTSVIKKVSERLAKEYDIVTTREPGGVLTSEEIRRIVLDGDSIDIRTEAMLFAASRREHLVEKIIPSLQAGKIVLCDRYIDSSLAYQGYARGIGIKEVKLLNEFAINGLYPDLTIYLDVDAEIGRQRILKNNREQNRLDKEEKAFHEKVIEGYQKVISDNPHRFIKVNANHSLDKVVEETYQSIIKYLK

SEQ ID NO: 3312 - protein, 106 aa, Staphylococcus epidermidis
GSLTARPTSRAGSKDGLSDPVVPHGRAIAQRIKATPGITGLSPPRVHIDGEVWHLDVGSSHPGAVICPKGWAVRPLKRYASWVQNVVRTVRSLSVVGVGKFERSCP

SEQ ID NO: 3313 - protein, 198 aa, Staphylococcus epidermidis
RPTASISSIKMIHGAFFLAFSNKSRTRLAPTPTNISTKSDPLIEKNGAPASPATARANNVLPVPGGPTSKTPFGILEPICLNFLLSFKKSTISINSCFSSSAPATSEKRTRRLLLSYILALDFPKFIIRPPPPPPWAWLRKKINNNAMINTGISVVKILTNTLCFSSSLTVNLRLSCFLAVSVIFCKSFSLLYKIVDE

SEQ ID NO: 3314 - protein, 159 aa, Staphylococcus epidermidis
MVKAYLGLGSNIGNRELQLNEAIKILHDYQGIQVTQVSHIYETEPVGYTNQPKFLNLCIEIETELNPQSLLKCCLTTEQQLHRKREIRWGPRTLDIDILLFGDQIIEQDNLSVPHPRMKERSFVLIPLNDIATKQIEPISNKSIGQLVVPDNSVKKYKE

SEQ ID NO: 3315 - protein, 69 aa, Staphylococcus epidermidis
FINLLFHVFLLKTLGAIYCFLISFNLYLSLLLYPSYLHMYCYSMKVDIASNQSKSTHFIILQDHQNVIK

SEQ ID NO: 3316 - protein, 461 aa, Staphylococcus epidermidis
SVNFNGGLAFMQRHAIILAAGKGTRMKSKKYKVLHEVAGKPMVEHVLNNVKQAGVDQIVTIIGHGAESVKDTLGNQSLYSFQDKQLGTAHAVKMAHEHLADKEGTTLVVCGDTPLITYQTLQSLIEHHESTQSHVTVLSASTINPYGYGRIIRNHNGILERIVEEKDANDSERAIKEISSGIFAFNNRVLFEKLEQVKNDNAQGEYYLPDVLSLILKDGGKAEVYCTEDFDEIIGVNDRLMLSEAEKALQQRINRYHMENGVTIIDPSSTFIGTDVKIGIDTTIEPGVRIGGHTTIEEDVWIGQYSEINNSTIHSNANIKQSVINDSIVGENTTVGPFAQLRPGSNLGSEVKVGNFVEVKKADIKDGAKVSHLSYIGDAEIGERTNIGCGSITVNYDGANKFKTIVGKDAFIGCNTNLIAPVTVGNHTLIAAGSTITDNIPEDSLALARARQVNKEGYLKK

SEQ ID NO: 3317 - protein, 298 aa, Staphylococcus epidermidis
KGDLTMTHDYIVRGLAYGGEIRAYAAITTESVQEAQTRHYTWPTASAAMGRTMTATVMMGAMLKGNQKLTVTVDGKGPIGRIIADADAQGNVRAYVDHPQTHFPLNDQGKLDVRRAVGTDGSIQVVKDVGMKDYFSGASPIVSGELGDDFTYYYATSEQTPSSVGLGVLVNPDNSIKAAGGFIIQVMPGATDETVTKLEEAISQMQPVSKLIEQGLTPEGILNEILGEGNVQILNSTSAQFECNCSHEKFLNAIKGLGEAEIHSMIKEDHGAEAVCHFCGNKYQYSESELEDLLETMK

SEQ ID NO: 3318 - protein, 181 aa, Staphylococcus epidermidis
IIMHKDLKNVLLSEEDIQNICKEMGAIITEDYKDRPLVCVGILKGSVMFMADLIKRIDTHLSIDFMDVSSYHGGTESTGEVQILKDLGASIENKDVLIIEDILETGTTLKSITELLQSRKVNSLEIATLLDKPNRRKADIEAKYVGKKIPDEFVVGYGLDYRELYRNLPYIGTLKAEVYSK

SEQ ID NO: 3319 - protein, 138 aa, Staphylococcus epidermidis
SQFNIHVTDEWIIQIAYDKLIIMAKSEMDQYILDRICIRKPGTYEFNDYQIDIHPDLPQQLYPLTVRVRQNGDVYKLNGQKGHKKVSRLFIDKKVTLAERQRIPLIINQENAVLAIGDLYVKENFKEFILISNNGDEL

SEQ ID NO: 3320 - protein, 296 aa, Staphylococcus epidermidis
MEYKDIATPSRTRALLDQYGFNFKKSLGQNFLIDVNIINKIIEASHIDCTTGVIEVGPGMGSLTEQLAKNAKKVMAFEIDQRLIPVLKDTLSPYDNVTIINEDILKADIAKAVDTHLQDCDKIMVVANLPYYITTPILLNLMQQDVPIDGFVVMMQKEVGERLNAQVGTKAYGSLSIVAQYYTETSKVLTVPKTVFMPPPNVDSIVVKLMQRQEPLVQVDDEEGFFKLAKAAFAQRRKTINNNYQNFFKDGKKNKETIRQWLESAGIDPKRRGETLTIQDFATLYEQKKKFSELTN

SEQ ID NO: 3321 - protein, 321 aa, Staphylococcus epidermidis
MLNNEYKNSSMKIFSLKGNEPLAQEVADHVGIELGKCSVKRFSDGEIQINIEESIRGCDVFIVQPTSYPVNLHLMELLIMIDACKRASAANINIVVPYYGYARQDRKARSREPITAKLVANLIETAGANRMIALDLHAPQIQGFFDIPIDHLMGVPILAQHFENDPDINPEECVVVSPDHGGVTRARKLADILKTPIAIIDKRRPKPNVAEVMNIVGDIEGRTAIIIDDIIDTAGTITLAAQALKDKGAKEVYACCTHPVLSGPAKERIENSAIKQLIVTNSIQLEENRKPNNTKELSVAGLIAKAIIRVYERESVSVLFD

SEQ ID NO: 3322 - protein, 118 aa, Staphylococcus epidermidis
YNDKKRCIKMKMIIAIVQDQDSQELSDQLVKNNFRATKLATTGGFLRAGNTTFLCGVKDDRVDEVLSVIDNTCGNRDQLVSPITPMGGSADSYIPYPVEVEVGGATVFVMPIEAFHQF

SEQ ID NO: 3323 - protein, 293 aa, Staphylococcus epidermidis
MNIKTDGWSKKAHIVVAVSTGIDSMSLLYSLLNDYQHTYRKLTCVHVNHGLREQSYEEEAFLREYCHQHHIDIYIKRLDLSDIVADGNSIQQEARQRRYEWFGDIIAQLRADVLLTAHHLDDQLETIIYRLFTGRSTRNSLGMTYESYFNQYKVYRPMLNLKKTEILAYQYANQIPYYEDMSNQDRKYVRNDIRQRIIPAINENPHLNAHQLLKLKDWHDIELQSLKEQAETFINNEVSKSKYLTYSFSRTAFNELNVNIKSVVMDLLFQKLDCHLAMPQHAYDECFEQIRNE

SEQ ID NO: 3324 - protein, 135 aa, Staphylococcus epidermidis
QAMNKKVEHIGNQYTSQENKKKQRQKMKMRVVRRRIALFGGILLAIILILLVLLVIQRHNNDQDAVERKEKETEFQKQQDEEIALKEKLNNLNDKDYIEKIARDDYYLSNKGEVIFRLPDDKKSSQSKTSNEKGN

SEQ ID NO: 3325 - protein, 125 aa, Staphylococcus epidermidis
RRMNMNDIIFLNGMRFYGYHGVLAAENDIGQIFVVDITLKVDLSYAGQSDDVKDTVNYGEVYKDVKSIVEGPRSCLIEHLAERIAKHINSHYNRVMETKVRITKENPPIPGHYDGVGIEIVREND

SEQ ID NO: 3326 - protein, 626 aa, Staphylococcus epidermidis
SQVKSMIANYISEDNRFQELDEVFGQENILVTGLSPSAKATIIAEKYLKDHKQMLLVTNNLYQADKIETDILQYVDDSEVYKYPVQDIMTEEFSTQSPQLMSERVRTLTALAQGEKGLFIVPLNGFKKWLTPVDLWKDHQMTLKVGQDIDVDAFLNKLVNMGYRRESVVSHIGEFSLRGGIIDIYPLIGTPVRIELFDTEVDSIRDFDVETQRSNDNINQVEITTASDYIITDEVIQHLQNELKKAYEYTRPKIEKSVRNDLKETYESFKLFESTFFDHQLLRRLVSFMYEKPSTLIDYFQKNAIIVVDEFNRIKETEETLTTEVEDFMSNLIESGNGFIGQGFMKYESFDALLEQHAVAYFTLFTSSMQVPLQHIIKFSCKPVQQFYGQYDIMRSEFQRYVHQDYTVVVLVETETKVERIQSMLNEMHIPTVSNIHEDIDGGQVVVTEGSLSEGFELPYMQLVVITERELFKTRQKKQRKRTKTISNAEKIKSYQDLNVGDYIVHVHHGVGRYLGVETLEVGDTHRDYIKLQYKGTDQLFVPVDQMDQVQKYVASEDKSPRLNKLGGTEWKKTKAKVQQSVEDIADELIDLYKAREMSVGYQYVLDTAEQSAFEHDFPYELTPDQ

SEQ ID NO: 3327 - protein, 701 aa, Staphylococcus epidermidis
RMQKAFRNVLVIAIIGVIIFGLFSFLNGNGNMPKQLTYTQFVNKLNKGDLKTLEIQPEQNVYMVSGKTKKDEDYSSTILYNNEKDLQKITDTAKKQDNLKFTVKEEEKQSVFVSILTTLIPVLIIALLFIFFLSQAQGGGGGGRMMNFGKSKAKMYDSNKRRVRFSDVAGADEEKQELIEIVDFLKDNKKFKQMGSRIPKGVLLVGPPGTGKTLLARAVAGEAGAPFFSISGSDFVEMFVGVGASRVRDLFENAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAAREGKNKIDMRDIEEATDRVIAGPAKKSRVISEKERNIVAHHEAGHTIIGMVLDEAEIVHKVTIVPRGQAGGYAMMLPKQDRFLMTEPELLDKICGLLGGRVSEDINFGEVSTGASNDFERATQIARSMVTEYGMSKKLGPLQFSSNSGGQVFLGKDMQGEPNYSGQIAYEIDKEVQRIVKEQYERCKQILLEHEEQLKLIAKTLLSEETLVAEQIQSLFYDGVLPEVDYDSAKVVKNENSDYSDGKYGKSYNDIRKEQLEDDDKEDDDNHEKDEVNQDNTDREADNTSHTNEPGHQQSPNIDKPYNPNDPNHRQ

SEQ ID NO: 3328 - protein, 242 aa, Staphylococcus epidermidis
WVSEEQVRRIQCLNLEIRKVEIRMASLKSIIRQGKQTRSDLKQLRNSGKVPAVVYGYGTKNTSVKVDEVEFIKVIREVGRNGVIDLGVGSKTIKVMVSDYQFDPLKNQITHIDFLAINMSEERTVEVQVQLVGEAVGAKEGGVVEQPLFNLEVTATPENIPETIEVDISELQVNDSLAVSDIKISGDFTIENNPEDSIVTVVPPTDEPSEEEVEAMEGESATEEPEVVGEDKEDDEEENKED

SEQ ID NO: 3329 - protein, 284 aa, Staphylococcus epidermidis
YRRDNMTTLYLVGTPIGNLGDITFRAIETLKKVDVIACEDTRVTRKLCNHYEIQTPLKSYHEHNKEQQTDYLIKQLQTGLNIALVSDAGLPLISDPGYELVVEARKNNINIETVPGPNAGLTALMSSGLPSFTYTFLGFLPRKEKEKIEVLEDRMFQNSTLILYESPYRVTDTLKAIAKIDSQRWITVGRELTKKFEQVLTLTVDDMLKLINHDKLPLKGEFVILIEGALPKSGESWFESYTVKEHVDYYIETKHVKPKKAIKFVATDRHMKTGDIYNIYHNID

SEQ ID NO: 3330 - protein, 319 aa, Staphylococcus epidermidis
IVKLKGVFWMAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 3331 - protein, 116 aa, Staphylococcus epidermidis
PLNRNELFERLMKLEHHVEQLTTDMSELKDLTVELVEENVALQVENENLKRLMNKTEESVETHLDKDNYKHVKTPSPSKDNLAMLYREGFHICKGELFGKHRHGEDCLLCLNVLSD

SEQ ID NO: 3332 - protein, 62 aa, Staphylococcus epidermidis
QLKRITFGYYKNWTYSNGYSFNLNELCINNKRKLHNLMKMGINKDYNNKESEHIFNVQTHLK

SEQ ID NO: 3333 - protein, 288 aa, Staphylococcus epidermidis
SLLSKIIRIEGFEKMRYKRSERIVFMTQYFMNHPNKLIPLTYFVKKFKQAKSSISEDVQIIKNTFQNEKLGTIITTAGASGGVTYKPMMSKSEATEVVDEVIEQLQEKDRLLPGGYLFLSDLVGNPSLLNKVGKLIASIYMNEELDAVVTIATKGISLANAVANVLNLPVVVIRKDNKVTEGSTVSINYVSGSSRKIETMVLSKRTLAENSNVLVVDDFMRAGGSINGVMNLMNEFKAHVKGVSVLVESKEVKQRLIEDYTSLVRLSDVDEYNQEFKVEPGNSLSKFS

SEQ ID NO: 3334 - protein, 110 aa, Staphylococcus epidermidis
RYTRGAHYMKVTDVRLRKIQTDGRMKALVSITLDEAFVIHDLRVIEGNSGLFVAMPSKRTPDGEFRDIAHPINSDMRQEIQDAVMKVYDETDEVIPDKNATSDNEESDEA

SEQ ID NO: 3335 - protein, 68 aa, Staphylococcus epidermidis; identical to SEQ ID NO: 3076

SEQ ID NO: 3336 - protein, 265 aa, Staphylococcus epidermidis
YNLRIGEIMMLIDTHVHLNDEQYDEDLNEVISRAREAGVDRMCVVGFDTPTIERTMELIDKYDFIYGIIGWHPVDAIDCTDERLEWIESLSKHPKIIGIGEMGLDYHWDKSPSDVQKEVFKKQITLAKRVQLPIIIHNREATQDCIDILIEEHAEEVGGIMHSFSASPEIADVVINKLNFYVSLGGPVTFKNAKQPKEVAKHVPMDRLLCETDAPYLSPHPYRGKRNEPERVTLVAQQIADLRGMTYEEVCRQTTENAERLFNLN

SEQ ID NO: 3337 - protein, 94 aa, Staphylococcus epidermidis
CVVRWGNMPKSILDIKNSIDCHLGNRIVLKANGGRKKTIERSGVLKETYPSVFIVELDQDKHNFERVSYTYTDVLTENVQVSFEEDNHQEAVAH

SEQ ID NO: 3338 - protein, 535 aa, Staphylococcus epidermidis
HGKSKTMDRLLCGDVGYGKTEVAVRAAFKAVMDGKQVAFLVPTTILAQQHYETLLERMQDFPVEIQLVSRFRTAKEIRETKEGLKSGYVDIVVGTHKLLGKDIQYKDLGLLIVDEEQRFGVRHKERIKTLKKNVDVLTLTATPIPRTLHMSMLGVRDLSVIETPPENRFPVQTYVLEQNTNFIKEALERELSRDGQVFYLYNKVQSIYEKREQLQMLMPDANIAVAHGQMTERDLEETMLSFINHEYDILVTTTIIETGVDVPNANTLIIEEADRFGLSQLYQLRGRVGRSSRIGYAYFLHPANKVLNETAEERLQAIKEFTELGSGFKIAMRDLNIRGAGNLLGKQQHGFIDSVGFDLYSQMLEEAVNEKRGIKERSPDAPDIEVELHLDAYLPAEYIQSEQAKIEIYKKLRKVETEEQLFDVKDELIDRFNDYPIEVERLLDIVEIKVHALHAGVELIKDKGKSIQIILSPKATEDINGEELFKQTQPLGRAMKVGVQNNAMNVTLTKSKQWLDSLKFLVRCIEESMAIKDED

SEQ ID NO: 3339 - protein, 323 aa, Staphylococcus epidermidis
VVFLHNEYHKGSKSLMDEQQQLANAYHSNKLSHAYLFEGDDAQTMKRVAIHFTKLILCNNSNQCELKVDTFNHPDFSYVSSDENTIKKEQIEQLVHHMNQLPIEGQYKVYIIEDFEKLTVQGENSILKFLEEPPDNTIAILLSTKPEQILDTIHSRCQHVYFKPIDKRQFIERLVEMSIARPVAEMLSTYTTQIEAASSLNEEFDLVTLRKSIIRWCQLILSNKAMALIGVIELLKQAKNRKLQLLTLSAVNGFFEDIMHAKIEMDNYYTFSDLTEEIENYANQLTFNQLILMYDQITEAHKKLNQNVNPTLVFEQIVIKGVI

SEQ ID NO: 3340 - protein, 86 aa, Staphylococcus epidermidis
KVFIMDKHFVYIVKCNDGSLYTGYAKDVNARVIKHNNGKGAKYTKIRRPVELVYQETYTTKSEALKREYEIKTYTRQQKLKMIQEG

SEQ ID NO: 3341 - protein, 61 aa, Staphylococcus epidermidis
LVIIHLLLANMKSIAHTCLLSIITMRDDNNIFTKSLKMYWYKLYIKKSLFTQFIREQKETY

SEQ ID NO: 3342 - protein, 281 aa, Staphylococcus epidermidis
EYIIEKGEIMIKTKIMGILNVTPDSFSDGGQYHSVDQAVKRAKEMIDEGVDIIDVGGVSTRPGHKEVSHKEVSLKEEMNRVLPVVESIVKYDVQISVDTFRSEVAEACLKLGVSMINDQWAGLFDSNMFNVVSQYGAEIVLMHNGDGHRDKPVVEEMLVSLLAQANKAELAGIPHNKIWLDPGIGFAKTREEENEVMARLDELVATEYPVLLGTSRKRYIKEMMNQDSSPSDRDEATAATTAYGIMKGVRGVRVHNVLLNTRLAQSMDFLKENEYERHHLS

SEQ ID NO: 3343 - protein, 201 aa, Staphylococcus epidermidis
RYIILIVEVTIMKCIVGLGNIGKRFELTRHNIGFEVVDDILERHQFTLDKQKFKGAYTIERLNGEKVLFIEPMTMMNLSGQAVAPLMDYYNVDVEDLIVLYDDLDLEQGQVRLRQKGSAGGHNGMKSIIKMLGTDQFKRIRIGVGRPTNGMSVPDYVLQKFSKEEMIIMEKVIEHSARAVESFIESSRFDHVMNEFNGEVK

SEQ ID NO: 3344 - protein, 134 aa, Staphylococcus epidermidis
KMSIEVGNKLKGKITGIKKFGAFVELPEGKSGLVHISEVADNYVENVEDHLSVGDEVEVKVLSIADDGKISLSIKKAKDRPRKPRHSKANHGKPVQKTEDFEKKLSNFLKDSEDKLTSIKRQTESRRGGKSSRR

SEQ ID NO: 3345 - protein, 182 aa, Staphylococcus epidermidis
FMKINEFIVVEGKDDTERVKSAVDCDTIETNGSAIDTYTLEVIQHAQQTRGVIVLTDPDFPGDKIRNTIREHVSGVKHAYVDREKAKSKRGKIGIEHANIKDIQEALMHVSSPLEEAKETIDKSVLIDLGLIIGKDARYRRNILGRKLHIGHSNGKQLLKKLNAFGYTEDDVRKALFEEEEN

SEQ ID NO: 3346 - protein, 426 aa, Staphylococcus epidermidis
CIRIQRNKALTFWRQIISNEERKTVMTHTITIVGLGNYGIDELPLGIYRFLEKESKVYARTLNHPVINTLKKEIEFESFDSIYEAHDRFEDVYEAIVTSLIELAQSEDIVYAVPGHPRVAETTTVKLLEYSHFNKDISVKVLGGKSFIDDIFEAVDVDPNDGFTLLDGTSLKESALNVRTNTVITQVYSVMIAADLKLTLMERYPDDFNVKIITGSHSDGAHVIECPLYEIDRYDDYFNNLTSLFIPKINEDTLLYQDFDYAVQTIDLLVDNEKGCPWDKVQTHDSLKRYLLEETFELFEAIDNEDDWHMIEELGDILLQVLLHSSIGKKEGYIDIKEIIESLNTKMIHRHPHIFGNAHVTSQEDLKDIWSRAKEKEGKVPRVKFEKVFADHFLKLYDKTKNRQFDEDISNNFYNKERKFMRLDKY

SEQ ID NO: 3347 - protein, 180 aa, Staphylococcus epidermidis
ERGMTLIIRALEKTDLSFIHHLNNEYSIMSYWFEEPYQSLSELENLYTKHILDETERRFIVEEGSTSVGVVELLEINFIHRTCEVLIIIDPQYANNGYAKKAFKMAIDYAFLVLNMNKVYLYVDIKNEKAVHIYQSNNFEIEGTLKEHFYTRGEYRDCYVMGLLKRNWVNKNDDDLSHIR

SEQ ID NO: 3348 - protein, 299 aa, Staphylococcus epidermidis
RLYVKIILITIQSEGGKMIYETAPAKINFTLDTLFKRDDGYHEIEMVMTTVDLNDRLSFEKRTDNKIVVDIEHNYVPNDNKNLAYKAADLMFERFNINEGVTISIDKDIPVSAGLAGGSADAAATMRGLNRLFGLGQSLDALAALGIQIGTDIPFCIYNQTAVCTGRGEQVTFLKRPPSAWVVLAKPNIGISSPDVFKALDLTEEHIVHNEKCKQALENNDYHLLCNSLSNRLEPVSMAMHPDIKKIKDNMLQCGADGALMSGSGPTVYGLAQKERQAKNIYNAVNGCCNEVYLVRLLG

SEQ ID NO: 3349 - protein, 133 aa, Staphylococcus epidermidis
KRSVKFIMKIINSDKVPEALGPYSHATVINGFVFTSGQIPLTLDGTIVSDDVQEQTKQVLENLTVVLKEAGSDLNSVVKATIYISDMNDFQQINQIYGNYFVEHQPARSCVEVSRLPKDVKVEIELIGKVKEL

SEQ ID NO: 3350 - protein, 660 aa, Staphylococcus epidermidis
GGPVMAKDTFYITTPIYYPSGNLHIGHAYSTVAGDVIARYKRMQGYDVRYLTGTDEHGQKIQEKAQKAGKTELEYLDEMISGIKNLWSKLEISNDDFIRTTEERHKQVVEKVFERLLKQGDIYLGEYEGWYSVPDETYYTESQLVDPVYENGKIVGGKSPDSGHEVELVKEESYFFNINKYTDRLLEFYDENPDFIQPPSRKNEMINNFIKPGLEDLAVSRTSFDWGVRVPSNPKHVVYVWIDALVNYISSLGYLSDDETLFNKYWPADIHLMAKEIVRFHSIIWPILLMALDLPLPKKVFAHGWILMKDGKMSKSKGNVVDPNVLIDRYGLDATRYYLMRELPFGSDGVFTPEAFVERTNYDLANDLGNLVNRTISMINKYFHGELPAYQGPKHELDEKMEAMALETVKSFNDNMESLQFSVALSTVWKFISRTNKYIDETQPWVLAKDENQREMLGNVMAHLVENIRFATILLQPFLTHAPREIFKQLNINNPDLHQLDSLQQYGMLSEAITVTEKPTPIFPRLDTEAEIAYIKESMQPPKSIKQSDEPGKEQIDIKDFDKVEIKAATIIDAENVKKSEKLLKIKVELDNEQRQIVSGIAKFYRPEDIIGKKVAVVTNLKPAKLMGQKSEGMILSAEKDGVLTLISLPSAIPNGAVIK

SEQ ID NO: 3351 - protein, 249 aa, Staphylococcus epidermidis
HPFFRSKDMLEDNERVDHLIKEGYEIIQNDEVFSFSTDALLLGYLTEVRKNDKVMDLCSGNGVIPLLLAAKSTQPIEGIEIQEQLVSMARRSFKLNDLNDRLTMHHMDLKDVYQTFQPAQYTLVTCNPPYFKMNQNHQHQKEAHKIARHEIMCNLKDCIEAARHLLKEGGRFIMVHRAERLMDVLTELRHGKIEPKALTLVYSKHDKPAQTIVVEGRKGGNQGLDIRNPLYIYNEDGSYSDEMKGVYYG

SEQ ID NO: 3352 - protein, 112 aa, Staphylococcus epidermidis
SSLFSSSSSSLSSPTTSGSSVADSPSIASTSSSEGSSVGGTTVTIESSGLFSIVKSPEILISETAKLSLTCNSLISTSIVSGIFSGVAVTSKLNNGCSTTPPSLAPTASPTN

SEQ ID NO: 3353 - protein, 524 aa, Staphylococcus epidermidis
LDVLKKVWRLKMKTKSETAFNGVVILTLALIIVKILSAIYRIPYQNVLGDDGLYAYQQIYPVVALGVILSMNAIPSAVTQVIGVNRSDEVYTRVMFRLQCIGFIVFILLFMFANMITRWMGDSNLAPMLKMASFSFILIGVLGVLRGFYQSKQVMTIPAISQVIEQVIRVSLIIVAIIMFSMKHWSIYQAGALAILASSIGFLGSMLYLLLKKPLKLKLCYRFNNTSIQWKQLFISISIFALSQLIVILWQVVDSFTIIRLLQHSGIAFKEAIIQKGIYDRGASFIQMGLIVTTTFSFVLIPLLTQAIREHNQIHMNRYANASIKITVVISTAASIGLINLLPLMNVVFFKSNHLTLTLSIYMFTVICVSLIMMNISLLQVQTSIRPIIMGVIIGILSKIILNVILIPFWGIVGASVSTVLSLLLFVIILQVAVLKYYRFNRISLFIVKLILGMIIMSIVVQTVMLALPSKSRMLGLLELIVSSIIGIVIIMLYIVIFNVLGYKEIKHLPFGDKLYQMKRGRRS

SEQ ID NO: 3354 - protein, 456 aa, Staphylococcus epidermidis
DEKLNLERVINMKRPIIQKLNHLIEKKAISMHVPGHKNMTIGYLNRLDLAMDMTEITGLDDMHYPEGIILESMENFRKHKNYDAFLLVNGTTSGILSVIQAFSTRKGKYLISRNVHKSVFHGLDITQQQATITKTDVSKKTNQYVNPKINQDKNQYYKLAICTYPNYYGETFDISQYIKQLHHRGIPILVDEAHGAHFGLDGFPESSMNFNADYVVQSYHKTLPALTMGSVIYIHKDAPLRQQVIDYLTYFQTSSPSYLIMSSLELANKFYKEYDSTLFDQRRKMLIDLLVNMGFTVIEPEDPLKLVVSFEGVEGYDVQKWFEDKEIYVELADMYQVLLVLPLWHEGDKFPFKLLIEKIREINVPKKCTRDIKPLNFMTGFSEYKTVHFQNTKEVSIKRAEGKVLAQHIVPYPPGIPVMFKGEVVTSHMIDLLNKYDKQNIKVEGLNHKKILVKDE

SEQ ID NO: 3355 - protein, 466 aa, Staphylococcus epidermidis
MNTSQKFRGDNRLLLGIILGVITFWLFAQSLVNLVVPLQSSYNSDIGTINIAVSLSALFSGLFIVGAGDIADKIGRVKVTYIGLALNIVGSVLIIITPLPSLLIIGRAIQGLSAACIMPATLAIINEYYIGTARQRALSYWSIGSWGGSGVCTLFGGLMATNLGWRSIFIVSIILTILSMFLIKHTPETKAEPIGDQPTETKKFDVVGLIILVVSMLSINVIITQTSQFGLFSPFILGLIAIFVISLIIFVIYENKIKQPLVDFDIFKNKGYTGATISNFMLNGVAGGTLIVVNTFYQQKLDFNSQETGYISLTYLIAVLIMIRVGEMILQSLGPKRPLLLGSALTVIGLILLSLTFLPNAWYIASSVIGYLLFGTGLGVYATPSTDTAVAQAPDDKVGVASGVYKMASSLGNAFGVAISSTVYSVLAAQLNLTLGGFTGVMFNALIALLAFLSILFLIPKKQSNV

SEQ ID NO: 3356 - protein, 76 aa, Staphylococcus epidermidis
GIIPYIYESTTIPTNNTAKIVPIVTKVLTAFLGAGFLKFVTALDIASTPVSDDAPDENAFKSKNNVTPGTVLPTVE

SEQ ID NO: 3357 - protein, 414 aa, Staphylococcus epidermidis
TYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 3358 - protein, 527 aa, Staphylococcus epidermidis
TNYLCLSKRWGAYIVSKTNLGEKWGLLAGGSLLVDYILTVAVSISSGADAFVAAFPHLYHFKVLIACLLVLFILMMNLRGLTESATVLSYPVYLFIIGLIVLIVVGTFRVATGQIAPHIHSTVGSTVPGVTLFLLLKAFSSGASSLTGVEAISNAVTNFKNPAPKNAVKTLVTMGTILAVLLVGIVVLSYIYGIMPQTETTVLSQLASQIFGENVAFYFIQATTVMILVLAANTGFTAFPMLAASMSKDKYMPRMFTVRGDRLGYSNSIIILGVLAIILIILFEGMTENLIPLYAVGVFIPFTLAQFGMVLKWLRERPERWGIKLTINLIGGTITFIVFMILLITKLNQVWPILLFLPFIVFIFIRIHVHYENIACELRSEIDIHDIPVVDRNLAIVPIQSITTVVDKSIYYAKLLANDDVIAVHVTFGDEDEQAFMTKWKKHFPDVRLVILHSEYRSIIHPISRFIDKIRKKANDKNYLITVVVPEFIPKKAWQHLLHNQTSLRLKLHLIYQKNVTLCTIPFKLIK

SEQ ID NO: 3359 - protein, 86 aa, Staphylococcus epidermidis
VCIACLKCGFLMLRCYFNVFSFYQNGKLYLLKITKPVTWLWLDRHLQLNISNVKVTMIKQTPKLHLLILSREVDKKEYSLLQIPTK

SEQ ID NO: 3360 - protein, 92 aa, Staphylococcus epidermidis
NNLAPNPLPNAPEPAIAIFIYSISLQFYIVFKILLYYIPVNIIRLICKNFLLIKNKYYLSNVHCSFDILLPICTVNRFFVNLLFYFSCVFKI

SEQ ID NO: 3361 - protein, 263 aa, Staphylococcus epidermidis
FHINLLRRNTLMKALIVDDEPLARNELQYLLNLNDAIDEIEEAENIEETLEKLLYNTFDLIFLDINLMDESGIDLAQKINKMKRSPHIIFATAHEKFAVKAFELNATDYILKPFEKERINQAVNKVDMAKDKPKNKDKTITPKYIDYSDDERAQTHVLPIEVDERIHILNFTDIIALSVNNGITTIDTTKQSYETTETLNHYEKKLPSSLFIKIHRATIVNKEHIQTIEHWFNYTYQLTLTHEFKYQVSRSYMKTFKQQLGLQ

SEQ ID NO: 3362 - protein, 234 aa, Staphylococcus epidermidis
AMIEHLGINTPYFGILVSLIPFVIATYFYKKTNGFFLLAPLFVSMVAGIAFLKLTGISYENYKIGGDIINFFLEPATICFAIPLYRKREVLKKYWLQIFGGIAVGTIIALLLIYLVAITFQFGNQIIASMLPQAATTAIALPVSDGIGGVKELTSLAVILNAVVISALGAKIVKLFKISNPIARGLALGTSGHTLGVAAAKELGETEESMGSIAVVIVGVIVVAVVPILAPILL

SEQ ID NO: 3363 - protein, 596 aa, Staphylococcus epidermidis
MRIDVMLNLFILLLERVGLIILLAYILMNINHFKTMMSERDKWRSKFQLIIIFGIFSMISNFTGIEIENGHIVSGDIYYHLSKDASMANTRVLTIGVSGLIGGPWVAIIVGIISGLCRLYIGGADAYTYLISSIVIAIISGYFGHQTIKQNTYPSIKKGAIIGAITEIIQMGCILLFTNNLHHAITLVSFIALPMIIINSLGTAIFLTIILSTIKQEEQMRAVQTHDVLQLANETLPYFRSGLNEKSAQQAAEIILKLMQVSAVAITNKKDILTHIGAGSDHHVARKEIITDLSKEVIQSGKLKVAHTREGIGCHHPNCPLEGAIVVPLYIHNEVAGTLKFYFTDNNIISTSDQQLAKGLANIFSSQLELGQAEMQGQLLKDAEIKSLQAQVNPHFFFNAINTISALVRIDSEKARRLLIQLSQFFRSNLNGARNNTITLQKELQQVAAYLSLEQARYPNRFNIHYRIDDQCQDALIPPFIIQILVENSIKHAFKNRKKNNHIDVDVSMKQDYLSISVQDNGQGIPADQLDTIGYTTVTSTTGTGNALVNLNKRLTGLFGTTSALNIQSSQSGTTVSCLIPYKSSKEEHFNESVNR

SEQ ID NO: 3364 - protein, 91 aa, Staphylococcus epidermidis
TKNEQVEQFLAKESQWQDCYKFLRNLIFNETELEENYKWMHPCYTINNKNAVLIHGFKGYVALLFQKGAILEEKYHTLIQQTERLQAEAVP

SEQ ID NO: 3365 - protein, 324 aa, Staphylococcus epidermidis
KYLDKWEELTLKKYLNYTLILIALSLIVLSGCSLPGLGDGNAKDDVKITTTETSETKIIGHMEKLLIEHETDGKIKPTLIGNLGSSIIQHNALQRGDANMSAVRYTGTELTSVLAAKPTKDPDKAMSETQRLFKKKYDEKYYHSLGFANTYAFMVTKETAKKYHLKKVSDLEKYKDELRLGMDTQWMNRAGDGYPAFVKDYGFKFDSARPMQIGLVYDALKNNKLDVAVGYSTDGRIAAYDLKILEDDRKFFPPYDGSPLANEQLIKDNPEIDKALKKLEGKISTEEMQKLNYEADGKGKEPAVIAEEYLKKHHYFEEKKGGHK

SEQ ID NO: 3366 - protein, 317 aa, Staphylococcus epidermidis
NCKEMEYMKIAIAGSGALGSGFGAKLFQHGYDVTLIDNWEPQVTTIQQDGLHIDINGEAHHFRLPMYRLTEIPKATSYDIVFLFPKSMQLEEVLSHIQPHLHDNTIVVCTMNGLKHERLIQQYVSIDRIVRGVTTWTAGIDQPGHTHLMGQGPVEIGCLVPEGKESVDIIVNLLQNAELKGVKSEHLHQSIWKKICVNGTANSLCTILECNLAALNNSDDAKNLIYKITQEIVHVATVDDVHLNVDEIFDYLIALNDKVGPHYPSMYQDLIKDNRTTEIDYINGAVSKLGKENHIATPVNDFVTNLVHAKENQRGAQ

SEQ ID NO: 3367 - protein, 64 aa, Staphylococcus epidermidis
PMTLDAIYQALGKNVKDNNINPMTVKALPSNKGLLGPNDCNIISPTRIIINTAIRYVSEIYPVS

SEQ ID NO: 3368 - protein, 510 aa, Staphylococcus epidermidis
SRGCSMKIKLFVIVVIFLMTILSIISITTREIAHSKNETILTHASQKHIDKMVETAMKKGDIPGLAILIIKDNKIFLNKGYGYANIEKKAKVNPHTQFEIASNTKAFTGYAILQLAQEGKINLNDKVSTFIPGFKMKYEDKERDITIEQLLAQTSGIPGDITEENRYSKQYDSIENIVNFAKGKRLNHVPGETFEYSNMNYDILGLIIQNVTHQSYTSYIQKHVLAPLKMKHTTFKVNNTKSNNEALGYIWEDNENKVAQPEFNIGDTPAAYMMSSTSDLAKWVQLQIHPTSKSQAKLIRQSHQVLSNSLNSEPNADSYGSGWFINTDDHLVFHTGVLDNFSSQILLNIRKSYGIVVLANTNSNQVTRLAEHLNTQIMNNRHYTTIEEKVNQTKDMQLIISTLADIFMVIFSILVFSKILKLREGHIFIRKCLRTSIMFSIILLGFVAMNILFYLLPLIILGDATWGFVLSWLPLHSKYLVVSVYLAITMLLVWLSLISITYRSDKKKKH

SEQ ID NO: 3369 - protein, 460 aa, Staphylococcus epidermidis
KYISKGLCLLFNFSHYLFNNCIRGLFLGHGTRHSLYRKGKTIMLSIKNLTKIYSGNKKAVDNISLDIQSGEFIAFIGTSGSGKTTALRMINRMIEATDGQIMMNGKDVRNMNPVELRRSIGYVIQQIGLMPHMTIRENIVLVPKLLKWSKEKKDEKAKELIKLVDLPEEYLDRYPAELSGGQQQRIGVVRALAAEQDIILMDEPFGALDPITRDTLQDLVKELQQKLGKTFIFVTHDMDEAIKLADKICIMSKGKVVQYDTPDNILRYPANDFVRDFIGQNRLIQDRPNMKSVESAMIKPVTVKADDSLNDAVNIMRTRRVDTIFVVNNQNKLLGFLDIEDINQGLRARKELIDTMQRDVYKVHINSKLQDSVRTILKRNVRNVPVVDNDEHLIGLITRANLVDIVYDSIWGEEDSDSYEIPNESLDENNHDLPQNQTDTRTNINEDVNDYHDAQHRGED

SEQ ID NO: 3370 - protein, 284 aa, Staphylococcus epidermidis
QKGSITMHKRLFITLLGFIILLAGCDYSKEENQTGIFYNVFVKSMDGFLHFLGRVFQDNYGFAIISIVLIVRFILLPFMLIQVKNMHMMREKTKVVQPELDAIRDKMKHATSQEERNAANQLLMKKYQSYGINPLKNMLGCLPVLIQMPILMGLYMSLKYPSSHGITEYPHFLWFDLTQPDLIMTIIAAIMYFVQPLVNSIHYPKDQRKTYYFMMVFSPIFITYASLHSAAALGLYWSISAAFLIVQMHFAHSHYKKVALHEAKKLKQKLEQNKDNSELLTEES

SEQ ID NO: 3371 - protein, 157 aa, Staphylococcus epidermidis
RKQRGMVILEQTHLVKNKTVDNKKSMKYSIFQQALTIAVILLISKIIESFMPIPMPASVIGLVLLFIALCTGIVKLGQVETVGTALTNNIGFLFVPAGISVINSLPILKQSPILIILLIIISTLLLLICTGFASQLLVTKSLFPSKEKNEETSHVGG

SEQ ID NO: 3372 - protein, 232 aa, Staphylococcus epidermidis
VMKGNLLHSIIEYYSLNWAFLLELFFKHLLMSVYGVLFACIIGIPIGIFIAKYKRLSWPVITIANIIQTVPAIAMLAILMLAMGLGPTTVVVTVFLYSLLPIIKNTYTGIVEVDENIKDAGKGMGMTGNQILRMIELPLSLSVIIGGVRIALVVAIGIVAIGSFIGAPTLGDIIIRGTNSTDGTTFILAGAIPIALIAIIIDIGLRYLEKRLDPTRKNKKDSMQKHQVQKLH

SEQ ID NO: 3373 - protein, 116 aa, Staphylococcus epidermidis
VFRGILDIFIVLGNYNKIGASIGTTATTITPTMTTAILPIDSSVSPNSLAAATPKVCPLVPSASPLAIGLDILNNLTILAPKAEMTTAFKITASEVNSLTPPIPSDTGNAIAVVAA

SEQ ID NO: 3374 - protein, 354 aa, Staphylococcus epidermidis
GVFIMKAAVWYGQKDVRVEDREPKAIKDNEVQVKVSWAGICGTDLHEYLEGPIFISTDQPDPLLGQTAPVTLGHEFSGVVENVGKNVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 3375 - protein, 214 aa, Staphylococcus epidermidis
GLIMKAFLQEYGSQLLSKAVEHFYISMFALLLAIVVAVPLGILLSKTQRTANVVLTVAGVLQTIPTLAVLAIMIPIFGVGKTPAIVALFIYVLLPILNNTVLGVKNIDKNVIQAGQSMGMTKFQLMKDVEMPLALPLIISGIRLSSVYVISWATLASYVGAGGLGDLVFNGLNLYQPPMIISAAIVVTLLALVIDFILSLVEKWVVPKGLKVSR

SEQ ID NO: 3376 - protein, 114 aa, Staphylococcus epidermidis
VKEVGVMFIQFKRLLIGRPKRNRDLKNEKISKFKGLAILSSDALSSVAYGPEQILITLSVIGAVASWYTLPIAGAVLILLTALILSYRQIIYAYPKGGERILFLKQILVRNGDC

SEQ ID NO: 3377 - protein, 84 aa, Staphylococcus epidermidis
GTPLELVFVNTLGPKPCFAKPNKILLLEYIPLFVADAAAVKTTKLTMPAAKGTPISVNNLTNGLLSGSTLNHGMTDMITSKPPI

SEQ ID NO: 3378 - protein, 220 aa, Staphylococcus epidermidis
NSSSLQTFKIFKSSICNNKTLIFYKYGYKSLLKFYLKGCHYMGIRSKLTNNITNKVGNSLLNIEEIKEKGDLPTTQEELRQRRERAETLVKKKSLLSSGASIVPIPGLDFGVDLKLMRDIIEDVNKIYGLDHDQVNSLSDQVKERIMSAAAIQGSQFIGRKVSEALLKVVIKDVAKRAAAKQTKWFPFVGQAVSASISYYFMSKLGKDHINKCEKVINNL

SEQ ID NO: 3379 - protein, 357 aa, Staphylococcus epidermidis
MKRFFQLIISAIVIGILCLMISHWFKSKDNTHSNEKLYVYNWGEYIDPSLIKKFEKETGIQVVYETFDSNEAMEAKIRNGGTHYDVAFPSEYTVQKLKKAKLLETLNHDKIPNIRNLDNDYMNLSYDPNNRYSIPYFFGTVGILYDKEKYPNETFDSWDDLYHSQFKNDILLVDGAREIIGMGLNKLGYSLNDKNPTHIYQAEKDLHNLAPQVRGIVGDEITMMLQQNEGHVAVVWSGVAAPLVQENTRYNYVIPKEGSNLWFDNMVIPKTAQNKEGAYKFMNFLLDAQNSAQNTEWVGYATPNKAARSKLPKKVRNDYRFYPSNQEQQRLEVYKDLGQTSLSEYNESFLNFKMSLK

SEQ ID NO: 3380 - protein, 318 aa, Staphylococcus epidermidis
FTISLYYMRNLRRGIMNKDQTLSHTTGRVSFKELQQIIKMALVQGNLIPAFAGAWLAIVMTNHSFLSSIPQILLMLVGSTLIMGGACALNNYYDQDIDRIMPSKQSRPTVNDRISDRNLLMLSFGMMLIGEACLFLLNIPSGVLGLIGIVGYVSYYSIWSKRHTTWNTVVGSFPGAVPPLIGWVAIDGSLSLAAVALFLVVFCWQPIHFYALAIKRSDEYALANIPMLPSVKGFKRTRVSMFIWLVLLLPLPFLLSNLGVTFVVIATLLNLGWLALGFTTFRKESNQTKWATQMFVYSLNYLVVFFALVVVVSLIKMI

SEQ ID NO: 3381 - protein, 413 aa, Staphylococcus epidermidis
VKFLASQLFKGGFFIDYLGVDISKRSSVVAHYKNGKFQKEFFIQNNKNGYNYLLKYLNDLHHPQLIFESTGIYSRGMQRFCCVNQINYIQMNPLEAKFKTSTLRSWKTDQADAHKLACLGPTLKQTGNLPIHELIFFELRERVRFHLEIENEQNRLKFQILELLHQTFPGLERLFSSRYSIIALNIAEIFTHPDMVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 3382 - protein, 574 aa, Staphylococcus epidermidis
IIMSKLIKGIAASDGVAIAKAYLIVEPDLSYDSNEKVTDIESEVEKFNDAIEASKIELTKIRNNAEAQLGADKAAIFDAHLLVLDDPELIQPIQDKIRNDKVNAATGLDEVTTQFISIFESMDNEYMKERAADIRDVSKRVLAHILGVDLPNPSLINESAVIVGNDLTPSDTAQLNKEFVQGFVTNIGGRTSHSAIMSRSLEIAAVVGTKSITEEVKQGDMIIVDGMSGDVIIDPTEDELIAYQNKRERFFEDKKELQKLRDADTVTVDGVHAELAANIGTPDDLSGVIDNGAQGIGLYRTEFLYMGRDQMPTEEEQFEAYKKVLETMDGKRVVVRTLDIGGDKELPYLDLPKEMNPFLGYRAIRLCLAQPEIFRPQLRALLRASVYGKLNIMFPMVATIKEFRDAKSMLLEEKENLLREGYEVSDDIELGIMVEIPATAALADVFAKEVDFFSIGTNDLIQYTLAADRMSERVSYLYQPYNPSILRLVKQVIEASHKEGKWTGMCGEMAGDQTAVPLLLGLGLDEFSMSATSILKARRQINGLSKNEMAELANRAVECSTQEEVVDLVNQLAK

SEQ ID NO: 3383 - protein, 350 aa, Staphylococcus epidermidis
IYLFFIDSFPPYYVKSLRLKSLRLFLFRYRNNPIPCYALIIMKYGDDDMSIPIIIDTDPGIDDATAISIALSHPQFDVKMISTVNGNVGIEKTTANALKLKRFFNSSVPVHRGASQPLINDIFEATSIHGESGMDGYEFPQINQDDLTSIHAVEAMRNLLVNTQEPLTLIAIGPLTNIAILLTSYPEVQPFIKEIVLMGGSTGRGNVTPLAEFNIYCDPEAAQIVFNSGLPLTMIGLDLAREALFTHHFVKDFKDTNATSNMLYNLFQHYKSEDFEIGFKLYDVFTILYLLDPEAFNVKEAYTQIELNGNFTRGATVVDFNMEHPNCTVVLSPVERQYEDLFLNALSYCK

SEQ ID NO: 3384 - protein, 234 aa, Staphylococcus epidermidis
VSLLYEGKAKRVFTTNIDGQLRVEYKDEVTAGNGAKKDTMIGKGKLNNQITSIIFDYLTHNHIDNHFIKQLSQTEQLVQQVDIIPLEVVVRNIATGSITKRLGFKKGHTFEEPLVEFFYKKDELNDPLITDDHVKLLGIANDEEIKQLKQMAKDINQVLIQLMNEMSLRLVDFKVEFGKTNGGKILLADEISPDTCRIWDKNTDTNFDKDVYRNNTGSLIETYQTFLNKLEDLK

SEQ ID NO: 3385 - protein, 73 aa, Staphylococcus epidermidis
SQLFLRYFFFTLNPTPNVAMRSINVKIINGTLATPNAKLNKVKKMTANIEKIQKIPLDFFCCIPYPTFYLSFQ

SEQ ID NO: 3386 - protein, 77 aa, Staphylococcus epidermidis
EDNTTMAVFKVFYQHNKDEVIVRENTQTIYVEGQTEEQVRRYLKDRNFNIEFITKLEGAHLEYEKEHSTHFNVENAE

SEQ ID NO: 3387 - protein, 85 aa, Staphylococcus epidermidis
TSNTKMANTVKINVPTIASIFLKPNFMMNNNKNTSNTVINAPTINGMPKIKSNAIALPITSAISVAIIANSAIIQNIIATGLFKK

SEQ ID NO: 3388 - protein, 97 aa, Staphylococcus epidermidis
RMNTIVKHTVGFIASIVLTLLAVFVTLYTNMTFHAKVTIIFGFAFIQAALQLLMFMHLTEGKDGRLQSFKVIFAIIITLVTVIGTYWVMQGGHSSHL

SEQ ID NO: 3389 - protein, 79 aa, Staphylococcus epidermidis
TKLTRCLMYKDYNMTQLTLPMETSVLIPTNDISRHVNDIVETILETEFRHHRDAISYHPKIMLKVVLYAYTQSVFSGRR

SEQ ID NO: 3390 - protein, 634 aa, Staphylococcus epidermidis
YNKTVAIKSGSIHKKGIYKMTNLREDVRNIAIIAHVDHGKTTLVDQLLKQSGIFRENEHVDERAMDSNDLERERGITILAKNTAIDYKGTRINILDTPGHADFGGEVERIMKMVDGVVLVVDAYEGTMPQTRFVLKKALEQNLKPVVVVNKIDKPAARPEGVVDEVLDLFIELEANDEQLDFPVVYASAVNGTASLDSEKQDENMQSLYETIIDYVPAPVDNSDEPLQFQIALLDYNDYVGRIGVGRVFRGKMRVGDNVSLIKLDGTVKNFRVTKIFGYFGLKREEIEEAQAGDLIAVSGMEDINVGETVTPHDHRDPLPVLRIDEPTLEMTFKVNNSPFAGREGDYVTARQIQERLDQQLETDVSLKVTPTDQPDSWVVAGRGELHLSILIENMRREGFELQVSKPQVILREIDGVLSEPFERVQCEVPSENAGAVIESLGARKGEMLDMMTTDNGLTRLIFMVPARGMIGYTTEFMSMTRGYGIINHTFEEFRPRVKAQIGGRRNGALISMDQGQATSYAIINLEDRGVNFMEPGTEVYEGMIVGEHNRENDLTVNITKAKHQTNVRSATKDQTQTMNRPRILTLEEALQFINDDELVEVTPESIRLRKKILNKSAREKEAKRVKQLMQDEQ

SEQ ID NO: 3391 - protein, 87 aa, Staphylococcus epidermidis
IMKTIELHITLQPQVLDTQGQALNRAVHDLGYEQVNDIRVGKVLYMTVNEPTDEAVDNIITTLSEKLFANTVIEEYSYKVIDEKEKA

SEQ ID NO: 3392 - protein, 80 aa, Staphylococcus epidermidis
IIYLIRFEIISFIFEFLTKRSLELKVLKLVKRDNFYIISYRNCLFYNFQTIISLLIYYLTYISSFNTNHIPSITSQLFLV

SEQ ID NO: 3393 - protein, 65 aa, Staphylococcus epidermidis
KLFYMTMHHLKEHSINKLKQYILLLTYLKSDTSYRHIIQLNSFYIRSYFSISNILFLYLIDKIYQ

SEQ ID NO: 3394 - protein, 248 aa, Staphylococcus epidermidis
VKSYLLIQSLKNIAIKLSMKRRKHNMKFAVLVFPGSNCDRDMYNAAIKSGVDAAYVDYRETTLDGFDGVLIPGGFSFGDYLRSGAMASVAPIIKEVKRFAKEGKPVLGVCNGFQILTEIGLLPGALLHNDSHLFISRNETLKITNNQTPFTHLYVKNENVVYPVAHGEGHYYCTDEIYRELNDNNQIILKYTNNPNGSYEDIAGIVNKEGNVCGMMPHPERALETLLGTNSGVKLFESMVKSWREQNV

SEQ ID NO: 3395 - protein, 608 aa, Staphylococcus epidermidis
KRYHIDFQTLSNWSDVSMYYTNSNYEAFARPKKPENVDNKSAYLIGAGLASLAAACFLIRDGQMKGENIHILEELDISGGSLDGINMEHHGYVVRGGREMENHFECLWDLFRSIPSLEQTNASVLDEFYWLNKEDPNYSKCRAIESGGKRIDTDGDFTLTKKAIKEILNLCLMKEEDLDDVKITDVFSRDFLNSNFWLYWKTMFAFEPWHSAMEMRRYLMRFVHHIGGLADFSALKFTKYNQYESLVLPMIEYLKSHSVNFEFGVQVNNILVDATPSTKIAREIILTRDDKEESIPLTVNDLVFVTNGSITESSTYGDNDHPAPITHSLGGSWTLWKNLANQSPEFGRPEKFCDHIPAKSWFVSATATTDNKKIISYIEQLCKRDVLSGRTVTGGIISVANSSWQLSFTVNRQQQFKKQPKNQVSVWIYALYSDEKGDFIKKPITECTGSEICQEVLYHMGVPQEEIVELAQSECNTIPVYMPYVTAYFMPRAYKDRPLVVPNGSKNLAFIGNFAETARDTVFTTEYSVRTAMEAVYQLLDVDRGVPEVYASEFDARVLMDAFYELNDRKSLHELVNKNFIKRSVLNTVLKKIRGTFIEELLRKHKLL

SEQ ID NO: 3396 - protein, 202 aa, Staphylococcus epidermidis
VMSHDANTIDSRTHEGELNKLGFWIFLTAEFALFGTLFATLLTLQHGGGYGGKLTTDLFELHLILIMTFALLISSYTCGIAIYYMRQEKQNLMMFWMIITVILGLVFVGFEIYEFAHYASEGVNPTIGSFWSSFFILLGTHGAHVSLGIVWVICLLIQIGTRGLDSYNAPKLFIVSLYWHFLDVVWVFIFTAVYMIGMVYSG

SEQ ID NO: 3397 - protein, 297 aa, Staphylococcus epidermidis
HMIQKLLNDIQQDDYAWKMDVLKKWKVNTLFERWKKRHTFVDDVNIITKLLLGIALFFFIIFIHNFDFMIYIVILMFMFLLLFNGTEFKITAIFILVTTLFALMSSLFMILYGDGEHMLVKFGILQISTESIVRGLHLSMRTITVSIFGILIALTSQIVMIFYSLMQHLKVKPKFAYAFMAAIRMVPLIISSLIQLRRSLKMRYQMIDASNYKGIKRLNHLVIPLLSQNIRRAHQLSVAMESKGFKDGPRTYYYRVPFSYKDIVFIACILIIITLSFVLSSYLPITGIHDVRFGQLD

SEQ ID NO: 3398 - protein, 210 aa, Staphylococcus epidermidis
LLTHNFPREGCAFFRRMFFMSKGLKLSEILVTVLISVVFAIIYNLWWFVYNIVQVAGIHLEQLTYGVWFMAAVVCYLIIPKPGIALLAEIAAGAGETIVMGKFDIPTIIYAILQGLACEIIFAIFKYKSRSAAVAMLAGLATALISFPVDYFYGYLNEVAGWNLLLFIVFRSISGIVLAGLVSYWIVKALDKTGVTKFFRPASQQDYDNL

SEQ ID NO: 3399 - protein, 407 aa, Staphylococcus epidermidis
SVRQTIKMKLNKFKIVFFIIVLLTLVVSIGILGVEWTRHLELKKQTLSQESGNTNYIEKRDKTVEKPKKIKTKYDKKDPTSKSINKYLEKTQFNGTVAVFDNGKVKMNKGYGYQDIEKGKKNTANTMYLIGSAQKFTTGLMLKQLEVENKVNLQDSVTKYIPWFKTNKEITIKDLMLHKSGLYKYEASTNIKNLEQAVRAIQARGIDDTVYHKHQYNDANYLVLAKVIENVTGKPYVKNYYERLGNKYNLKHTAFYDEKPLQSEMAKGYKFKNNTFSFLKPNILDQYYGAGNLYMTPHDMGKLIYTLQQNKIFNARQTRPILHEFGTQEYPEEYRYGFYITPYLNRVNGVFFGQIFTVYFNDRYIVILGTNVSNTPGLVSNEDKMRHIFYNILDQKKPYNTAGVKVE

SEQ ID NO: 3400 - protein, 222 aa, Staphylococcus epidermidis
INFKSLCYNIHNHIKRRHIMTQYTFSPKDFKAFEVEGLDQRMEALNDYVRPQLHQLGSYFEEYFTTQTGETFYAHVAKHARRSVNPPIDTWVAFAPNKRGYKMLPHFQIGLFRNQLFIMFGIMHEGRNKEEKVKIFDKHFDKLTSLPSDYSVSLDHMKTEKHYIKDMSNEELHAAIDRVKNVKKGEFFVARTLSPTDKRLKSDKSFLKFVEETFDEFLKFYQ

SEQ ID NO: 3401 - protein, 290 aa, Staphylococcus epidermidis
EWFKVVAKILDGKQIAKEYRQRLKNQVNDLKEYGFTPKLSVILVGNDGASQSYVKSKKKAAEKIGMISEIIHLDESTSEEVVLSELNRLNNDDTVSGILVQVPLPKQVSEQKVLEAINPEKDVDGFHPINIGKLYIDEQTFVPCTPLGIMEILKHADINLEGKNAVVIGRSHIVGQPVSKLLLQANATVTILHSRTKNMNAHLKQADVIVSAVGQPGLVTKENVKKGAVIIDVGNTPDENGKLKGDVAYDEVKEIASAITPVPGGVGPLTITMVLNNTLLAEKLRRGLTK

SEQ ID NO: 3402 - protein, 91 aa, Staphylococcus epidermidis
VVLKSLLAKICCTSSLLLSVFSKLAIDVSLLKDTSAINIETIVNMSKNTQLNQPNIFSVSRFAGRLICVYCSPNIRYNSLTYLSHYYIKKF

SEQ ID NO: 3403 - protein, 370 aa, Staphylococcus epidermidis
MAPKLQAQFDAVKVLNETQSKFEMVQILDEDGNVVNEDLVPDLTDEQLVELMERMVWTRILDQRSISLNRQGRLGFYAPTAGQEASQLASQYALESEDFILPGYRDVPQIIWHGLPLTDAFLFSRGHFKGNQFPEGVNALSPQIIIGAQYIQTAGVAFGLKKRGKNAVAITYTGDGGSSQGDFYEGINFASAYKAPAIFVIQNNNYAISTPRSKQTAAETLAQKAISVGIPGIQVDGMDALAVYQATLEARERAVAGEGPTVIETLTYRYGPHTMAGDDPTRYRTSDEDAEWEKKDPLVRFRKYLEAKGLWNEDKENEVVERAKSEIKAAIKEADNTEKQTVTSLMDIMYEEMPQNLAEQYEIYKEKESK

SEQ ID NO: 3404 - protein, 516 aa, Staphylococcus epidermidis
FRRKNKRKRFRYQTKMGRGYSSMSNYSGLNEECGVFGIWNHPEAAQLTYMGLHSLQHRGQEGAGIVVSNHETLKGERGLGLLTEAIKDEHMSNIKGYPHAIGHVRYATSGNKGIENIQPFLYHFYDMSVGICHNGNLINAKSLRQNLEEQGAIFHSSSDTEVIMHLIRRSKAPTFEEALKESLRLIKGGFTFAILTKDALYGAVDPNAIRPLVVGKMENGAYILASETCAIDVLGAEFIQDIHAGEYVVITDEGIEVKTYTRQTTTAISAMEYIYFARPDSTIAGKNVHAVRKASGKRLAQENPAKADMVIGVPNSSLSAASGYAEEIGLPYEMGLVKNQYVARTFIQPTQELREQGVRVKLSAVKDIVDGKDIVLVDDSIVRGTTIKRIVKMLKDSGANRIHVRIASPEFMFPCFYGIDVSTTAELISASKSPEEIKNHIGADSLAYLSVDGLIESIGLDYDAPYHGLCVESFTGDYPAGLYDYEKNYKKHLSERQKSYIANNKHYFDSEGNLHV

SEQ ID NO: 3405 - protein, 473 aa, Staphylococcus epidermidis
WRGKNMVVGDFPIETDTIVIGAGPGGYVAAIRAAQLGQKVTIVEKGNLGGVCLNVGCIPSKALLHASHRFVEAQNSENLGVIAESVSLNYQKVQEFKTSVVNKLTGGVEGLLKGNKVEIVRGEAYFVDNNSLRVMDEKSAQTYNFKHAIIATGSRPIEIPNFEFGKRVIDSTGALNLQEVPNKLVVVGGGYIGSELGTAFANFGSEVTILEGAKDILGGFEKQMTQPVKKGMKEKGIEIVTEAMAKSAEETENGVKVTYEAKGEEQTIEADYVLVTVGRRPNTDELGLEELGLKFADRGLLEVDKQSRTSIENIFAIGDIVPGLPLAHKASYEGKVAAEAIDGQAAEVDYIGMPAVCFTEPELAQVGYTEAQAKEEGLSIKASKFPYAANGRALSLDDTNGFVKLITLKEDDTLIGAQVVGTGASDIISELGLAIESGMNAEDIALTVHAHPTLGEMTMEAAEKAIGYPIHTM

SEQ ID NO: 3406 - protein, 69 aa, Staphylococcus epidermidis
SIFNSSYFIGSSIKLGTIPLNTLSNVLLPDPEGPSKSTFSLFLISRFKLLNIFLSPFGYFKRKFLTRNN

SEQ ID NO: 3407 - protein, 106 aa, Staphylococcus epidermidis
VMNKLLQSLSALGVSATLVTPNLNAEATTNTEPQLKGVNDIVIEKGQEYNLLKGISAYDKEDGDLTHKIKIDGQVDTSKAGKYKVKYQVTDSDGAEKTSIRNIEVK

SEQ ID NO: 3408 - protein, 356 aa, Staphylococcus epidermidis
LIINIILIVREIYMSKAYEESGVNIQAGYEAVERITSHVERTLRKEVLGGLGGFGATFDLSQLKMKAPVLVSGTDGVGTKLKLAIDYGKHDTIGIDAVAMCVNDILTTGAEPLYFLDYIATNKVVPSTIEQIVKGISDGCEQTNTALIGGETAEMGEMYHEGEYDIAGFAVGAVEKEDYIDGSNVEEGQAIIGLASSGIHSNGYSLVRKMIKESGVQLHDQFNGQTFLETFLAPTKLYVKPILELKKHIDIKAMSHITGGGFYENIPRALPKGLSAKIDTQSFPTLEVFNWLQKQGNISTNEMYNIFNMGIGYTIIVDKKDVQTTLTTLRAMDTTAYEIGEIIKDDDTPIHLLEVE

SEQ ID NO: 3409 - protein, 318 aa, Staphylococcus epidermidis
RNPNKNSKTTKTEQFKQVNKDAENPKPKERIGTWIGKDIKTLTHHYGQADRSYPYKNGLKNYVFKQKDEYYIVSTNKGTITSVYATGKGVKVSPLKIGESSSHIFEDTSINPEPTVKTKGKTYKFEMSDEDLKTQTLIKYGDVYAQIYSDQQTNKILAVRFLDANTLATLQPYKLNRAEDEGQISESSDDKIPHEQNPNQLITLYEVTNKMREMKNLNSLKVNNDIARIAAINLYEATDKGSNSVEFTENALTQQLDERHVSYKSASQNVGYDFDDVPTLIHSWINSDIHRSRLLSNKYDEMGGEVMSDYYSLIFVEK

SEQ ID NO: 3410 - protein, 408 aa, Staphylococcus epidermidis
YMKNFKNIMRYIGKTSKFIDYPLLITYVVLCLIGLVMVYSASMVAATKGTLTGGVPVSGTYFYNRQLLYVIMSFVIVFFMAFIMNVKVLKKPNVQKGMMIGIFILLLLTLVIGKNINGSKSWINLGFMNLQASELLKISIILYIPFMIEKKMPAVRHNIKLILGPILFVVTCLILVLFQKDVGQTMLIVIIFFSIIFYSGIGVQNMLKWGALVAIGFIIVATFMFMLDMVPSYLQARFSTLTNPFSQESGTGYHISNSLLAIGNGGLFGRGLGNSIMKLGYLPEPHTDFIFAIICEEMGLIGGLIVLILEYFIVYRAFQLANKTQSYFYKLVCVGIASYIGSQTFVNIGGISATIPLTGVPLPFISFGGSSMISLSIAMGLLLITAKQIKQDDKRLKQRKVDIKRRYN

SEQ ID NO: 3411 - protein, 183 aa, Staphylococcus epidermidis
VVRKMDIGYKLRNLRRIKNLTQEELAERTDLSKGYISQIESNHASPSMETFLNLIEVLGTSASDFFKEPSDEKVLYKKKEQTIYDEYDKGYILNWLVANSNEFDMEPLILTLRPNASYKNFKPSESDTFIYCLNGEVSLQLGNQVYKACKEDVLYFKAKDKHRLYNETDKEVKVLIVATASYL

SEQ ID NO: 3412 - protein, 178 aa, Staphylococcus epidermidis
LNRKVEKRLAWIANILSLLFLIFGILSIFVINNTSNQQQYNELMKQFSGNNQDMSSEMFLVSLIASLVILGFSTLLGFVGTMVIEGIKNLAATLLIAAAIVGLFTTNLIAMVLWMIAAIRLFAKKDKTDVNENATAQLRQNHSKSQSDWNHQQNQQHKDAWDPEQEINKQKKDDPYIY

SEQ ID NO: 3413 - protein, 140 aa, Staphylococcus epidermidis
YNLKIKEFDLFMKQSFIKIGEGLTDLFEFTTLIEYNHKRINRIVYFHTPHSEKQLSSVAIIMNPTAEKHFQAMYIMTNALKYPYPEGNKKFNMINSAAENYDIPVVGIDVQPPDVYPDLELYFNYLISVLRLQRWIPPLQ

SEQ ID NO: 3414 - protein, 76 aa, Staphylococcus epidermidis
SHMKWSITQLRKYQGKPFEFNQTVNFEHLRESLDLIDLSDINVEGQLTVKSNEVIADMHVTGTYTMPCAVFTTRGW

SEQ ID NO: 3415 - protein, 210 aa, Staphylococcus epidermidis
QFMNFKKTVAIVLTSAVLLAGCTIDKKEIKKYDDQVQKAMDQEKTVNQVSKKINELEEKKQKLFKKVNDKDQSTRKKAAEDIVENVKQRQKEFEKEEKALDNSEKEFKQAKQYLEHVENKAKKKEVEQLDSAIKEKYKSHDAYAKAYKKALNKEKELFSYLNEDNATQSEVDGKSKDLSKAYKEMNNKFNAYSKAIEKVKREKQDVDQLK

SEQ ID NO: 3416 - protein, 158 aa, Staphylococcus epidermidis
VRMKLMNVPILPTISTSCIVISAILVAIGWALIWKRQVHKHKNIMLWAAFFALTFFIIYAARTIFIGNTAFGGPSSIKVYYTIFLVFHIILATVGGVLGLIQIILAFKDKLHIHRKIGPWASIIWFFTAITGVAVYVLLYVLYPGGETTSLLKATLGL

SEQ ID NO: 3417 - protein, 223 aa, Staphylococcus epidermidis
WRTNMDKEYVVIGLGRFGGSIVRELNALDMDVMAIDRDENRVNEYSDIATHAVVADTTDEAVMKSLGIRNFDHVIVAIGENIQSSTLTTLILKELGVKKVTAKAQNDYHAKILNKIGADTVVHPERDMGRRIAHNVASASVLDYLELADEHSIVELKSTEKMAGQTIIELDIRAQYGINIIAIKRAKEFIVSPDPNINIEIGDILIMIGHDNDLGRFEKNISK

SEQ ID NO: 3418 - protein, 437 aa, Staphylococcus epidermidis
EDKNVAFEFRLPDIGEGIHEGEIVKWFIKAGDTIEEDDVLAEVQNDKSVVEIPSPVSGTVEEVLVDEGTVAVVGDVIVKIDAPDAEEMQFKGHGDDEDSKKEEKEQESPVQEEASSTQSQEKTEVDESKTVKAMPSVRKYARENGVNIKAVNGSGKNGRITKEDIDAYLNGGSSEEGSNTSAASESTSSDVVNASATQALPEGDFPETTEKIPAMRKAIAKAMVNSKHTAPHVTLMDEIDVQELWDHRKKFKEIAAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 3419 - protein, 187 aa, Staphylococcus epidermidis
MKWKCESMRVIAGKHKSKALESLEGRNTRPTMDKVKEGIFNSLYDVSGLGLDLFAGSGALGIEALSRGMDKMIFVDQNFKAVKVIKANLNQLDLMSQAEVYKNNADRALKALAKREIQFDVIFLDPPYNKGLINEAISRIAEFNLLKENGIIVCEFSHNEKITIAPFQMIKRYHYGLTDTLLLEKGE

SEQ ID NO: 3420 - protein, 79 aa, Staphylococcus epidermidis
CMTDTVIIYTQDDCPPCAFIKNYLVNKNIKFTEKNIKNQKYKNEMMDYDAFATPFILLKGMPMYQVDMEKLNDELNITP

SEQ ID NO: 3421 - protein, 149 aa, Staphylococcus epidermidis
IKDDSVITEETLDILDDIEDISDMIVQSDIYVSYRRAKMQLDADDEASLLYQAFLKVKDKYDDVMRFGKYHPDYKDIMLETRKRKRAYEMLPVVMEYKAKEVALQNLIDEVMSKIALAVSEHVKIETGNPFFQTGHDGCASGGTCNCSL

SEQ ID NO: 3422 - protein, 300 aa, Staphylococcus epidermidis
FSGEDVGVNGGVFRVTEGLQKEFGEDRVFDTPLAESGIGGLALGLAVTGFRPVMEIQFLGFVYEVFDEVAGQIARTRFRSGGTKPAPVTIRTPFGGGVHTPELHADNLEGILAQSPGLKVVIPSGPYDAKGLLISSIQSNDPVVYLEHMKLYRSFREEVPEEQYKIDIGKANVKKEGNDITLISYGAMVQESLKAAEELEKDGYSVEVIDLRTVQPIDIDTLVASVEKTGRAVVVQEAQRQAGVGAQVAAELAERAILSLEAPIARVAASDTIYPFTQAENVWLPNKKDIIEQAKATLEF

SEQ ID NO: 3423 - protein, 60 aa, Staphylococcus epidermidis
SNYDILFIHIRPPLYKRGMITNIPQSLIISFLPHMLCRKQIILIIILTMELIKVNLKQKQ

SEQ ID NO: 3424 - protein, 63 aa, Staphylococcus epidermidis
LQQDIDNMKRYTHKSRVFYYKVDRKVTLYTKYDKKVQVSERITLTTMGLNYNLCFVSNTMIEL

SEQ ID NO: 3425 - protein, 167 aa, Staphylococcus epidermidis
KFREWAFMIQIKGAVNFPISLDSTTWIFDDRKVTIDDLERGVFDGTRPINFDDNKEWNRAILEGQTNPPTLDSEIKYKKRSVLDETFVINMTPFFKNAEPMENASTIKLSNKDYSINVPMDLLPYLFFQFSSNGKRLYSDNAVDSFIYIPEEGYSHQFKYVTHIEVI

SEQ ID NO: 3426 - protein, 112 aa, Staphylococcus epidermidis
YLALLYSWQYSLKSIKVQHLLLKYHLHTLRQHQYQLCHAFHSQLLILTLYPHRQYLIPELALSFLIETNQMLHQIHLNHLILLCAMYVQHDLLFFRLLHILLEYLHQIPHML

SEQ ID NO: 3427 - protein, 172 aa, Staphylococcus epidermidis
QILCYLKKENNMSKTRAVIPGSFDPITYGHLDIIERSADRFDEIHVCVLKNSSKGGTFDSEERMTLIEESVKHLPNIQVHHFNGLLVDFCDQVGAKTIIRGLRAVSDFEYELRLTSMNKKLNSNIETMYMMTSANYSFISSSIVKEVAAYQADISPFVPPHVERALKKKFNV

SEQ ID NO: 3428 - protein, 1154 aa, Staphylococcus epidermidis
GVSWLLKQIKKLLVANRGEIAIRIFRAAAELNISTVAIYSNEDKSSLHRYKADESYLVGSDLGPAESYLNIERIIEVALRAGVDAIHPGYGFLSENEQFARRCAEEGIKFIGPHLEHLDMFGDKVKARTTAINANLPVIPGTDGPIESFEAAEQFANEAGYPLMIKATSGGGGKGMRIVRESSELEDAFHRAKSEAEKSFGNSEVYIERYIDNPKHIEVQVIGDEFGNIIHLYERDCSVQRRHQKVVEVAPSVGLSNKLRERICDAAIQLMENIKYVNAGTVEFLVSGDEFFFIEVNPRVQVEHTITEMITGIDIVKTQILVANGESLFGDKISMPQQNEIQTLGYAIQCRITTEDPTNDFMPDSGTIIAYRSSGGFGVRLDAGDGFQGAEISPYYDSLLVKLSTHAVSFKQAEEKMERSLREMRIRGVKTNIPFLINVMRNDKFRSGDYTTKFIEETPELFDIAPTLDRGTKTLEYIGNVTINGFPNVEKRPKPEYESTKIPKISQKKINQLFGTKQILEQHGPTGVTNWVREQEDVLITDTTFRDAHQSLLATRVRTKDMMNIASKTAEVFKDSFSLEMWGGATFDVAYNFLKENPWERLERLRKAIPNVLFQMLLRASNAVGYKNYPDNVIKKFVHESAKAGVDVFRIFDSLNWVDQMKVANEAVQEAGMVSEGTICYTGDILNAERSNIYTLDYYVKMAKELEREGFHILAIKDMAGLLKPKAAYELIGELREATHLPIHLHTHDTSGNGLLTYKQAIDAGVDIIDTAVASMSGLTSQPSANSLYYALNGFPRNLRTDIDGLEELSHYWSVVRPYYADFESDIKSPNTEIYQHEMPGGQYSNLSQQAKSLGLGERFDEVKEMYRRVNFLFGDLVKVTPSSKVVGDMALYMVQNDLDEDTVINDGYKLDFPESVVSFFKGDIGQPVNGFNKKLQDVILKGQQPITERPGEYLEPVDFEAIRQELSDIQQDEVTEQDIISYVLYPKVYKQYIQTKEQFGNVSLLDTPTFLFGMRNGETVEIEIDTGKRLIIKLETISEPDENGKRTIYYAMNGQARRIYIQDENVKTNANVKPKADKSNPNHIGAQMPGSVTEVKVSVGDEVQANQPLLITEAMKMETTIQAPFDGIIKQINVANGDAIATGDLLVEIEKQS

SEQ ID NO: 3429 - protein, 383 aa, Staphylococcus epidermidis
SQKWRKCKMNFSKLKFGATIGIIGGGQLGKMMAQSAQKMGYKVIVLDPNEDCPCRYVAHQFIHANYDDEQALNQLGENSDVVTYEFENISSEQLKKLTQLYHIPQGYQAIELLQDRLTEKQTLLEANTQIVPFVQIHTNQDLLKAIEKLGFPCIVKTRFGGYDGKGQILVRNDSELDEAYQLVEKQECVAEQYLDIQKEVSLTVTIGNEQQTTYFPLQENEHQNQILFKTVVPARSDKENEARKEVEKITRAIHFVGTFTVEFFIDKENNLYVNEIAPRPHNSGHYSIEACDYSQFDTHILAITGQKLPQAIELLKPTVMMNLLGRDLDLLENEFSRHPDWHIHIYGKKERKPDRKMGHMTLLTDDVNQTEQYMLMKFEGRDK

SEQ ID NO: 3430 - protein, 668 aa, Staphylococcus epidermidis
SWRWTLMNFPWDQLLVKGNWMIISAQIAAPFLVIGLIAVISYFKLWKYLYKEWFTSVDHKKIGIMYLISAVLMFVRGGIDALMLRTQLTIPDNKFLEANHYNEVFTTHGVIMIIFMAMPFIFGLWNVVIPLQLGARDVAFPVMNNVSFWLFFAGMILFNLSFIVGGSPAAGWTNYAPLAGEFSPGPGVNYYLIAIQISGIGSLMTGINFFVTILRCKTPTMKFMQMPMFSVTTFITTLIVILAFPVFTVALALMTADRIFGTQFFTVANGGMPMLWANFFWVWGHPEVYIVILPAFGMYSEIIPTFARKRLFGHQSMIWATAGIAFLSFLVWVHHFFTMGNGALINSFFSISTMLIGVPTGVKLFNWLLTLYKGRITFESPMLFSLAFIPNFLLGGVTGVMLAMASADYQYHNTYFLVAHFHYTLVTGVVFACLAGLIFWYPKMMGYKLNETLNKWCFWFFMIGFNVCFLPQFILGLDGMPRRLYTYMPSDGWWLLNFISTIGAVLMAIGFLFLVASIVYSHIKAPREATGDNWDGLGRTLEWSTASAIPPKYNFAITPDWNDYDTFVDMKEHGRHYLDNHNYKDIHMPNNTPVGFWMGIFMTIGGFFLIFESIVPALICLAGIFITMIWRSFQIDHGYHIPASEVAETEARLREARIKEREAVSHES

SEQ ID NO: 3431 - protein, 566 aa, Staphylococcus epidermidis
CGERRIMKQLHSNEVGVYALGGLGEVGKNTYAVEYKDEIVIIDAGIKFPDDNLLGIDYVIPDYTYLEQNQDKIVGLFITHGHEDHIGGVPFLLKQINVPIYGGPLALGLIRNKLEEHHLLRTTELHEIDESSVIKSKHFEISFYLTTHSIPEAYGVIVDTPEGKIVHTGDFKFDFTPVGEPANIAKMAQLGHEGVLCLLSDSTNALVPDFTLSEREVGQNVDKIFRNCKGRIIFATFASNIYRVQQAVEAAIKYNRKIVTFGRSMENNIKIGMELGYIKAPPETFIEPNKINSVPKHELLILCTGSQGEPMAALSRIANGTHKQIKIIPEDTVVFSSSPIPGNTKSINRTINALYKAGADVIHSKISNIHTSGHGSQGDQQLMLRLIQPKYFLPIHGEYRMLKAHGETGVQCGVDEDNVFIFDIGDVLALTHDSARKAGRIPSGNVLVDGSGIGDIGNVVIRDRKLLSEEGLVIVVVSIDFNTNKLLSGPDIISRGFVYMRESGQLIYDAQRKIKGDVISKLNSNKDIQWHQIKSSIIETLHPYLYEKTARKPMILPVIMKVNEDK

SEQ ID NO: 3432 - protein, 466 aa, Staphylococcus epidermidis
PNILFRLIYSHILMGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPHIIDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 3433 - protein, 299 aa, Staphylococcus epidermidis
VCILNQKQYTSWYQVKLKKNLISELKVMRTIIMHNINKWLLVPYLLWMVIFIIIPVILLVYFSFIDIHGHFSFTNYEQVFSTRYLKMFIDSIWYAALITMITLIISYPAAYFISYSRFQNILLMLLIIPTWINLLLKTYAFIGLLGHDGVINQALHIFQIPKLNLLFTSGAFLLVASYIYIPFMILPIFNSMKAIPNNILQASNDLGASTFTTFRKVIVPLTREGIKTGVQVTFIPALSLFMITRLIAGNKVINVGTAIEEQFLTIQNYGLGSTIALFLIIFMAFLLIITKSKSSNGKG

SEQ ID NO: 3434 - protein, 100 aa, Staphylococcus epidermidis
KVFRTKNKKHLQSRKIDVEPVFGFMKAILGFTRMSVRGINKVKRELGFVLMALNIRKVTAQRAENNQKNNKKDNFYIISIEIVFFIYLGTLSPTLFIYVR

SEQ ID NO: 3435 - protein, 170 aa, Staphylococcus epidermidis
QSKSFERVYKVKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKSLVAKVEEMQNELQ

SEQ ID NO: 3436 - protein, 73 aa, Staphylococcus epidermidis
LITGVNHCPPAEPILLIVHVAPFISSEVNLPSRAFTASSLISSEISNIDLRSACLTTGTNNPLSVSAAIPIFQ

SEQ ID NO: 3437 - protein, 384 aa, Staphylococcus epidermidis
RMLGEQYTQIKRPANRLTEKILGWFSWVFLLILTIVSMFIALVSFSNDTSIANLENTLNNNELVQQILANNDLSTTQFVIWLQNGVWAIIVYFIVCLLISFLALISMNIRILSGFLFLIAAIVTIPLVLLIVTLIIPILFFIIAMMMFARRDRIETVPSYYNEYDQPYYDERGFYEPESRNEHGYNDDVYEPMHTKKEDRNTRRQFNRNAQQQDSYNGITDNQPDEDTSSDQLYSDEYVDNEDKYSQFPKRAVESEYASQQTEDEPTVMSRQAKYNKKSKNTDFEDAQQEHMEGNQFDDVGVVEPQIDPKELKAQRKREKAEIRAKKKEKRKAYNKRMKERRKNQPSAVNQRRMNYEERRQMINNEQEDTDNNLNQQEDSKKEN

SEQ ID NO: 3438 - protein, 95 aa, Staphylococcus epidermidis
LYKGEFNMEQKSYVITDETGIHARPATMLVQTASKFDSDIQLEYNGKKVNLKSIMGVMSLGVGKDAEITIYADGSDETDAIQSITDVLSKEGLAE

SEQ ID NO: 3439 - protein, 382 aa, Staphylococcus epidermidis
RSEGFNRCHSFIFIGGNCMNPLLSFKDVSKGFEDVQILNEINIDIEPGYFYTLLGPSGCGKTTILKLIAGFEYPDSGDIIYKDKPIGKMPPNKRKVNTVFQDYALFPHLNVFDNIAYGLKLKKLSKSEIKRKVTEALQLVKLSGYEHRQIQGMSGGQKQRVAIARAIVNEPEILLLDESLSALDLKLRTEMQYLLRELQSRLGITFIFVTHDQEEALALSDYIFVMKDGKIQQFGTPIDIYDEPVNRFVADFIGESNIVHGTMVEDFVVNIYGQNFDCVDMGIKENKKVEVVIRPEDISLVSQNDGLFKAKVDSMLFRGVHYEICCKDRKGYEWVIQSTKKANVGSEVGLYFEPEAIHIMVPGETEEEFDKRIESYEDYHHA

SEQ ID NO: 3440 - protein, 735 aa, Staphylococcus epidermidis
KVGGNKMSKFIEPSNEEIKLEKLYQDIGLSDKEYDKVVEILGREPNFTEVGIFSVMWSEHCSYKHSKPFLKQFPTTGEHVLMGPGEGAGVVDIGDNQAVVFKVESHNHPSAIEPYQGAATGVGGIIRDIVSIGARPINLLNSLRFGELTVKQNQRLLKGVVSGIGGYGNCIGIPTTAGEIEFDERYDGNPLVNAMCVGIIDHDMVQKGTAKGVGNSVIYVGLKTGRDGIHGATFASEELTEESESKRPSVQIGDPFVGKKLMEATLEAITFDELVGIQDMGAAGLTSSSSEMAAKGGSGLHLRLDQVPTREPGISPYEMMFSETQESMLLVVEKGTEQKFLDLFNKHELDSAVIGEVTDTDRFVLTYDDEVYADIPVQPLADEAPVYILEGEEKEYNTSKNDYSNIDVHDTFIKLLQHPTIASKHHLYEQYDQQVGANTIIKPGLQASVVRVEGTQKAIASTIDGEARYVFNQPYEGGKMVVAEAYRNLIAVGATPLAMTDCLNYGSPEKKEIYQQLIDSTKGMSEACKVLQTPVVSGNVSLYNETRGTSIFPTPVVGMVGLIEDVSYLKEFKPKAGDKIYLVGETRDDFGGSQLEKLLYGSVNHEFESIDLSDEVSKGKLIKQAIRNGIASHVQTVGKGGLLVTLAKISAHYDLGMQAQLDVTNAQLFSETQGRYIVVVKEGQTLDIDQAQEIGHLTHQQLFDISNSDVKIKENVSDIKQKWEGAIVQCLTTQD

SEQ ID NO: 3441 - protein, 419 aa, Staphylococcus epidermidis
KERGNLLKVLIVGAGGREHTLASKINQSPIVDKVYAIPGNDAMVNIAEVHSEIAESDHQAILHFAQHNAIDWVIIGPEQPLIDGLADLLRNANIKVFGPGQDAAQIEGSKLFAKQLMDKYRIPTAEYKEVSSRNEALQYVETCDLPIVIKKDGLAAGKGVIIAFTREDALEGVKKIYQEEKGKVVFESYLEGEEFSLMTFVNGDYAVPFDCIAQDHKRAFDNDQGPNTGGMGAYCPVPHIDASVLEQTNKEIAQPIAKAMAQEGHDFFGLLYIGAILTKDGPKVIEFNARFGDPEAQVLLTRLESDLMQLIIDLENCQPIHFNWKDEAVVGVMLASKGYPGSYEKGHEISGFNLDSHYYVSGLKKEGQCFVNSGGRVILAIGEGPTVEKAQANAYEHARQIKSDNLFYRNDIGNKAITK

SEQ ID NO: 3442 - protein, 391 aa, Staphylococcus epidermidis
TKIIGKPYICSIRRSKKVSKFKSLLLLFGTLILLSGCSNIEVFNAKGPVASSQKFLIIYSIIFMLVIVAVVLSMFAIFIFKYSYKKNSESGKMHHNSLIETIWFVVPILIVIALAIPTVKTLYDYEKPPEKDKDPLVVYAVSAGYKWFFAYPDQHIETVNTLTIPKDRPVVFKLQSMDTMTSFWIPQLGGQKYAMTGMTMNWTLTADQLGTFRGRNSNFNGEGFSRQTFKVHSVSQNDFDKWVKEAKGKKTLSQDTFDKQLLPSTSNKELTFSGTHMAFVDPAADPEYIFYAYKRYNFEQKDPNFTAEEDLYKDVKDKPIKPARKVHITNPNYERHGMKPMILGNNEKYDNEFKKEEDHNSKEMEKISKGAKDENASKLHKKEHDDHGGGH

SEQ ID NO: 3443 - protein, 84 aa, Staphylococcus epidermidis
EMNIIPRTSLIIYLKHMKHERQIRKYGHIVHSNRQRKYVVMYINEADADNIVHKLMQLKYVHEIQGSPYKYLKKTYEKEKHEIQ

SEQ ID NO: 3444 - protein, 442 aa, Staphylococcus epidermidis
TIFIYNNFEVNSMSFLRKHTEIIFSYIIGIVSLFTGLIIFINLPLIKQFKGDKKVDTHVHNVWEFLNAFFAEIIKVMSKFIGGFPITSAIVIIVFGILVMLLGHTLFRTIKYDYDISIFFLVIGIMYFIITLLLMTQVYGFFAIVFIIPFTVHIGYIVYKDELNQDNRKNHYMWIIVTYGMSYLITQISLYGRIDANEIESIDILSVNTFFIIMWLLGQMAIWNFLFLRRSLPLTKEELGEEEPELSRTNKGNVSNQTKVHLKQLQNKTTEYARKTRRSVDLDKIRAKRDKFKQKINSIVDIQEDDIPNWMKKPKWVKPMYVQLFCGVIILFFAFLEFNNRNALFLTGEWELSQTQYVVEWVTLLLLLFIIIIYIATTLTYYLRDKYYYLQLFMGSILFFKFLTEFINIMVHGLLLSIFITPILLLMLIAMIVAYSLQLREK

SEQ ID NO: 3445 - protein, 281 aa, Staphylococcus epidermidis
YVVIGDDTMALYDFAKGLILEAGNKVRLMMQEELDIKTKSNPNDLVTNVDKATENYLYETILHNYPDHQVIGEEGHGHNLEYLKGVIWVIDPIDGTLNFVHQKENFAISIGIYHDGKPYAGFVYDVMKDVLYHAKVGQGAFENTHKLEMIQNTELKRSIIGINPNWLSKPILSDIFSSIVNEARSARAYGSAALEIISVAKGQLAAYLTPRLQPWDFAGGLLILNEVGGIGTNLLGDKLDFNQPNSILIANPSLHREILNHHLNQQRDTLITLHEKRFGKR

SEQ ID NO: 3446 - protein, 210 aa, Staphylococcus epidermidis
SNKIFEYLLMYLCLSYLIYYLIRKVYDMITMKDIIRDGHPTLREKAKELSFPLSNNDKETLRAMREFLINSQDEETAKRYGLRSGVGLAAPQINEPKRMIAVYLPDDGNGKSYDYMLVNPKIMSYSVQEAYLPTGEGCLSVDENIPGLVHRHHRVTIKAQDIDGNDVKLRLKGYPAIVFQHEIDHLNGIMFYDYIDANEPLKPHEEAVEV

SEQ ID NO: 3447 - protein, 382 aa, Staphylococcus epidermidis
KGEMQMKSVGLITEYNPFHNGHLFHATLSKQRSETNVTIAIMSGNFVMRGEPAIYHKFKRTKMALSAVDLVVELPLIGSLSSSDTFAEIAIKTAQYLDIDIISFGSESASLKDLQYLATQMIDYEKHPDFKEKLKQGKSYPRILSELTHNDTLLQSPNNILGISYLKAMQQFAPHMSALTIKREGSLHHQKVIDHHHFASGTSIRRSLMNDNVDWKNVVPNQIQSLYCKPHTTVEDTFPFIKHQLITQPKESLHSIYTINEGFENRLQTMIHRSDSFESLLSNLKTKRYTQTYIQRVLMNVLLNITKDDVNKEINAVRVLGMSEKGRSYLKYLKANYPNRHYITNVNQKTAHYFKNEIKATHVYNLLSNQSQTDFNTPLVRI

SEQ ID NO: 3448 - protein, 340 aa, Staphylococcus epidermidis
NKMIYAYIGITVLWVFLFCYIIIASIDFGAGFFALHSKMTGNEKKVNHLIHRYLNPVWEVTNVFFVFFFVGFIGFFPDSAKYLGTVLLVPGSIALILISIRSSFYAFENYGQDTKLPWIVLYGLTGLLIPASLATALTISEGGYIYEHGTHIDLDWIQLLLSPFAWSVVFLAIVSVLYISSGFLTYYAHKANDQPAYDMTRQWHIFWGPPMIVISLFVFLSLRIQNSDHFRTAIFNYWWMFAISFIFFIIAGLLTIFKKKHGLAFIMVILQMLFAFFGYGMSKLPYLLYPFIKITDSHVNPEMGLSLVIVFVLGLLLLIPSLILLLRLFVFDKAYVEGKK

SEQ ID NO: 3449 - protein, 312 aa, Staphylococcus epidermidis
EDSIMAHSKKWFINGTLATAGIISSLFYFLKNKNKSPQQLKSIPPFFSGQAPYIFAHRGGMAMRPEQTQLAFDNAVEYGLDGFETDVRLTKDEQLIVFHDALVDRTTNGSGKVSEHTLAELKRLDAGYHFTDINNQTPYRGHDKAKILSFEELLELYPNMYINVDLKDAPDTYEGRIAPKVIYDNIIKHGAQHRVLVTSFHKKQIQRFTEYNQADIAIGASEGEVAEGFIKFNGMLGHTFKPQADTFQMPVAYKGISLTSKRFIQWLNLNNIVPGYYGVNSIDLMTDLYHKGVHTLVTDRPDLGQQFKETLK

SEQ ID NO: 3450 - protein, 67 aa, Staphylococcus epidermidis
DGTVSILSLLANIIIAMIKNKIGMIRVTINNTSGIVTIAAIKKRKPDKILIFIEINAKNEMSKQTIK

SEQ ID NO: 3451 - protein, 95 aa, Staphylococcus epidermidis
GEYVMSNQSKLNSAAYDQLNKDADRILHLIKVQMDNLTLPSCPLYEEVLDTQMFGLQKEVDFAVQLGLVDKEDGKQLMLRLEKELSKLHEAFTNV

SEQ ID NO: 3452 - protein, 467 aa, Staphylococcus epidermidis
LLRVKNLRLKYPNGDRKIFNNLNLEIKNKEKVLLLGPSGSGKSTLLNVLSGIVPNLIELPMKYDELNIDHDSGVIFQDPDNQFCMPKVYEELAFVLENRNIPRSEMDQEIEDALKSVDLNVTHKTYVNNLSGGMKQKLAIVETILQKSKTLFLDEPTAMLDVKATEDLWKKLINLWEDQTVLIVEHKVEHIWQHVDRVLLLNYDGEIVADDTPEQILDHYEALLTEYGVWHPRAWHSAPRPIPLPNQTKNLLFHFDDGQIIRGKKTLFSSKELKLYSGEWLTITGKNGAGKTSLLEAMLQLIKYEGDMFYRDQLLSKIKQAAKHMYLVYQNPELQFITNSVYDEVYIHYNHLDPKHANDETMDLLKLLHLDQVKDHHPFEISTGQKRRLSVATALSSKAEIILLDEPTFGLDSHNTFQLIKLFQERVNQGQTIIMVTHDPEIIKRYPTRRLRVEDGCLKEMEGEHIV

SEQ ID NO: 3453 - protein, 73 aa, Staphylococcus epidermidis
NKCLYIFLAKMIMTFLFNHTTTLKRLKDFKYFNCNLIILWLSVTHPVTFKNYNATNIMIFIMSTNTNTCSRTL

SEQ ID NO: 3454 - protein, 451 aa, Staphylococcus epidermidis
MDSVEIARLLTGMTLAVHIIFATIGVGMPLMFAIAEFIGIKKNDANYITLAKRWSKGYTITVAVGVVTGTIIGLQLSLVWPTFMKMGGHVIALPLFMETFAFFFEAIFLSIYLYTWERFKNKWTHFFISIPVIIGGSFSAFFITSVNSFMNTPAGFEIKNGRMVNVQPLEAMFNSSFMVRALHVVATAGMTMAFILAAIAAFKLLRHNHTEDRTYHTKALNLSMIVGFINTVLSMIAGDLSAKFLHKVQPDKLAAYEWHYDTQSHANLVLFGVLNEKTHEVSGALEIPGLLSFLADNSFNTKVKGLNEFPKNELPPMIVHYFFDLMVSMGIFCFIISGLYMLFLIVKKLRKYVTSNMMLYAILLTGPASMLAIEFGWFLTEMGRQPWIIRGYMRVSEAATQAGGITLVTTLFGLLYLLLLVTSAYVLIRMFKNQPAYKDVEKVIKERGETK

SEQ ID NO: 3455 - protein, 102 aa, Staphylococcus epidermidis
KIKVYEGEDTMEYQYPLDLHWTNDEMMKVIHFFNKIENYYEASVKGDEVLNAYKNFKHIVPGKADEKQIFKEFENKSGYNSYKVVQEIKKNPNQTLFSKDFD

SEQ ID NO: 3456 - protein, 276 aa, Staphylococcus epidermidis
WEGVISVKWYGKLYIALLISVLYIPIFFLMIYSFNSAGNMSHFEHFTLEHYHSLFHNDRLMSVIFNTVAVALLSASIATVIGTFGAIALYYLRNKRFKVTLLTMNNVLMVSSDVVIGASFLIMFTAIGHFTGLGLGFSTVLASHIAFCIPIVVIIVLPQLYEMNDNMLNAARDLGANESQLLTSIIIPNIMPSIIGGFFMALTYSLDDFTVSFFVTGNGFSVLSVEVYAMARKGISMEINAISTIIFIAIMFGVFGYYFIQHIVNRQKKMKRGVNE

SEQ ID NO: 3457 - protein, 503 aa, Staphylococcus epidermidis
LKSLNRGVSYRMKKAILSVSNKSGIVEFAKALTNLDYELYSTGGTKRVLEDANINIKSVSELTQFPEIMDGRVKTLHPAVHGGILADRDKEHHLEQLREQHIDLIDMVVVNLYPFQQTVAQPDVTETDAIENIDIGGPTMLRAAAKNFKHVTTIVHPSDYNEVIERIKNHQLDEAYRKSLMVKVFQHTNEYDHAIVNYFKDNKETLRYGENPQQSAYFVRTSDSKHTIAGAKQLHGKQLSFNNIKDADAALSLVKKFNEPTAVAVKHMNPCGVGIGQSIDEAFQHAYEADNQSIFGGIIALNRTVDVKLAEALHSIFLEVVIAPQFTEEALKILTQKKNIRLLQIDMTIDNAEQEFVSVSGGYLVQDKDNKDVTRNDMTVATDIQPTEAQWEAMLLGWKVVSAVKSNAVILSNNKQTVGIGAGQMNRVGSAKIAIERAIEINDNVALVSDGFFPMGDTVEYAAEHGIKAIIQPGGSIKDQDSIDMANKYGITMVMTGMRHFKH

SEQ ID NO: 3458 - protein, 312 aa, Staphylococcus epidermidis
YFKLMMGCLSLFRKQNLKWLGVLATIIMTFVQLGGALVTKTGSEDGCGSSWPLCNGALLPENLPIQTIIELSHRAVSAISLIVVLWLVITAWKNIGYIKEIKPLSIISVGFLLVQALVGAAAVIWQQNPYVLALHFGISLISFSSVFLMTLIIFSIDKKYEADILFIHKPLRILTWLMAIIVYLTIYTGALVRHTKSSLAYGAWPIPFDDIVPHNAHDWVQFSHRGMAFITFIWIMITFIHAIKNYSDNRTVRYGYTASFILVILQVITGALSVITNVNLIIALFHALFITYLFGMIAYFILLMLRTTRSLK

SEQ ID NO: 3459 - protein, 198 aa, Staphylococcus epidermidis
YTYSFIGGRIVTNIAIFASGSGSNFENIVKHIQTGQLSGINVTALYTDNEGVPCIDRAKNLNIPIHINKPKDFSSKSLYEQHLLKLLSSEEVQWIVLAGYMRLVGQDLLQAYEGRILNIHPSLLPKFKGLDAIGQALESGDTVTGSTVHYVDSGMDTGEIIEQQQCDIKPDDTKEQLEDRVKHLEYELYPRVIAKIIK

SEQ ID NO: 3460 - protein, 395 aa, Staphylococcus epidermidis
ERYSFMKLATLNKGKETKYLNHYPLIDEEDLFEHDHLKEGDLITLVTEQQQYIATGYIGRQHKGLGWVLSYNQNEEINTLFFKRLFEAALEERQYYFNIEGTNAFRLFNAEGDGVGGLTIDNYNGHLLIQWYSKGIYKFRFPILEAIKEVYEYTSIFEKMRFKGTSYTGGFVEGNAPEFPIVVEENFTFYNVDLNDGLMTGIFLDQKEVRKKLRDQFSERRHVLNLFSYTGAFSVIAAENANSTTSVDLANRSRGLTEENFGLNGINPKSQYIYVMDTFDFYNYAGRHGHQYDTIVIDPPSFARNKKKTFSVQKDYNLLIEGALNILSPGGTLLLCTNSSAFSLKAFKNVIKKTLAQNNIVYEINEVMGLPKDFKTHPHYKPSKYLKAVFVTIKH

SEQ ID NO: 3461 - protein, 269 aa, Staphylococcus epidermidis
FLLSVECIDLFGCSGAPDCAGVPGSTGLPGSTGLPDSAGLPGSAGVPGSAGLPGSAGVPGSAGLPGSAGVPGSAGLPGSAGVPGSAGVPGSAGLPGSAGLPGSAGLPGSAGVPGSAGLPGSAGVPGSAGLPGSAGLPGSAGLPGSAFVGPYSTISSTGCLVTFSVDLPSPTFSPVIGLTNIGVVIVFVPGSPFCLTRSSPGFKSGLNTRFLSNGISSVDVIGLPTFGPYFVTSSTGGVTTSPVSGFLTPGLPGTSVLLSTGAFGSNSSL

SEQ ID NO: 3462 - protein, 125 aa, Staphylococcus epidermidis
VMTSIVVVSHSHKIAEGVKQLINQMTDGGVDLIAVGGLSDDEIGTSFDQIVSVINGLENDALCFYDIGSAGMNLDTALEMYEGDHKIVKMEAPIVEGSFIASVGIKSNMSMDSVISEVRAKYPEE

SEQ ID NO: 3463 - protein, 538 aa, Staphylococcus epidermidis
KLGSYSTNPTITCIQYSTSSIFGDDSMKTYKPYRHQLRRSLFASTIFPVFMVMIIGLISFYAIYIWVEHRTIHQHTYQTQTELQRIDKHFHTFVTQQQKQWRHVDLSHPADITKMKRQLLKQVHQQPAILYYDLKGSSQSFTNNYEQLDTTKMYLISKYRIDFKDDTYILKIYMSSTPLLKNIKKNSGQSALIVDSYDTVLYTNDDRFSIGQKYQPPQFGFINESLKLNSHHAHLIIYKDIHETIEDGIALLVVMGVVLILLVIFGYISADRMAKRQSEDIEAIVRKIDDAKNRHLGSYEPLKKHSELEEINNYIYDLFESNEQLIQSIEQTERRLRDIQLKEIERQFQPHFLFNTMQTIQYLIPLSPKVAQTVIQQLSQMLRYSLRTASHTVKLAEELSYIEQYVAIQNIRFDDMIQLYIDATEGVQHQTIGKMMLQPLVENAIKHGRDSEPLKITIRIRLTKRKLHILVHDNGIGMSPSHLEHVRQSLHHDVFDTTHLGLNHLHNRAMIQYGTYARLHIFSRSQQGTLMCYQIPLV

SEQ ID NO: 3464 - protein, 2404 aa, Staphylococcus epidermidis
CKLFMSYYGNEYERRTLMNIEALYFQKYFYFKHLNQSSSEHRVTYWVKLSRDIELRRLMYALLDVVQSQPVLRTQFVTDDFNQLKINLRDFFPFIEIKEVNEMSQSIDLEAFFTRNLNSYHFNQLPLFNFKIYQFLDEAYLLLDFHATIFNESQLTPFLQQLNIAYTHSLKSEYSISDFYNWIKEMNQKMDQNQVVCPSKHFNVLNADGDNYAYIPVKNTCEKKKMCSLHAELPSLDIDVWIVSIYLAHHFISQSSDVTLGIHFSIDNKNTENMMVLNTDIAPLNLSISQSDVVKDMVDECSALLEELQMCGASFVVQPKAVQIDVETMIHIEKVQEQFELNHICHHIHRLYNEASSFADLEFYPHVQDGFDIVYNDNVYDDLTVHTLVKLINGIYMQITQNPSLLIKDIKLSDRSDLAKYNDINLQNNDINYSEVTYKTVVERFERQVHQHPDSIALQYEQRSMTYHQLNQCANLLAYRLRLNHQIEPNDMVALIAERSLEMIIGMLGILKAGAGYIPIDPDYPEERMNYIIEDAKPKAVVTYRTSFQSGLPQMDIELIVDSREHDIDNPRGINCSEDIAYVIYTSGTTGKPKGTLVPHRGIDRLVHNPNYVELNENTTVLLSGTVAFDAATFEIYGPLLNGGRLVITSKDTLLNPQLLDQAITENKVNTMWLTSSLFNQIASERIEALESLTYLLIGGEVLNAKWVHLLNSRECHPQIINGYGPTENTTFTTTFAIPQEMPSRIPIGLPISGTTVYVMQGDRICGVGVPGELCIGGAGLAKGYLNQPKLTAERFIQSPFNNEMLYRSGDLVRLQEDGYIDYISRIDKQVKIRGFRIELSEIEKALEAIRDINKAVVIVREQDQDKQIVAYYEASQLKSTGQLKDILSETLPEYMIPVHFMKVDRIPITMNGKLDVRALPEINLKNNRNYVEPRNDIERTVCRIFEEILHVDQVGVKDNFFELGGHSLRATLVVNRIEERLKKRLKVGDLMKSPTVEQLGQQIEELQNDVYEVIPKANESYQYDLSASQKSMYLLWKVNPKDTVYNIPFLWRLSSELNVMQLQRALSKLIERHEILRTQYVIDDNEVKQRIATHVSPDFEEVTTSLTNEQDIIQSFMEPFDLEQPSQMRVKYIHGPQQDYLFMDTHHSINDGMSNTILLSDLNALYQDKSLPELKLQYKDYSEWMVHRDLSKQRHFWLQQFENQVPILNMPTDYPRPSIKTTNGNMLTFHYNRQIKQQLKSYVEQHQVTDFMFFASAIMVLLHKYTRQDDIAIGSVISARTHRDTENMLGMFANTLVYRGRPHDQKTWDQLMAEMKEMCLGAYEHQEYPFESLVNDLVDERDASHNPLFDVMLVLQNNETNHANFGHSQLTHIPPQSTTAKFDLSFIIEEDQDDYVVNIEYNTDLYKQETIHHIAEQLQMIIKHVISTENLKIQDIDENDDLLIWLDKHVNDCSLDLPKNKSIQQLLHDVMKAKADDVALKMNGQSMTYQELDDYSNSMAQTLIQNGIQKGERVALLTERSFEMVASMIAVLKVGGSYVPIDVTYPDKRIEFIIEDAEVAAVLTYGKAISSHIPVIKIEDIDNTENNKRLNIEYAGNLEDDMYHIYTSGTTGKPKAVSVKQRNILNLVCAWTKRLNLSDDEVYLQYANYVFDASATDFYCSLLNGYPLVIATSVERTNTDLLEKLISQENITIASIPLQVYNVMHHFYIPKVITGGAPSTPAFVQHISKHCDMYVNAYGPSENTVITSCWIYEKGDAIPSTIPIGKPLANVDIFIMSGGKLCGVGIPGELCIAGESLTSGYLNRPELSAEKFINNPFGPGQLYRSGDLARLMPDGQIEFLGRIDKQVKVHGYRIELGEIENIINSVDTVTDSVVILAKQGEREVLHAYYVGSQEDENHISQHLNQYLPKYMIPKTLTAISEIPLTGNDKVDESRLPVPNVHKNKFVAPRNNIEREIAQIVSGVLDVSSMSIDDDFFEMGGTSLDAMVVVSKLKSNGIHITMQDVYQFKTVRYIANHTEKRQALPEVVLPDHLPQLQSLVERRYQLKSQHLTQSSLGHVLLTGATGFLGAYLIDEMQDDADQITCIVRGHDINQAKTNLENNLNCYFDTAHVDKLMKHIDIILADLSELDHLIIDSAIDTIIHAGARTDHFGDDETFFDVNVRSTQALIDLAKNKKAKLIYISTISVGTVFEVHQDDITFSEKDLYKGQLFTSPYTKSKFYSEIKVLEAVNEGLAAQIIRLGNLTSASTGPLNMKNLTTNRFSIVMHDLLKMPFIGESISKAKVEFSFIDVTARHIIKLARSNAIPIIYHVYAPCSITMKQVIDNAKGSEMTVVSDSEFEQKLHELGMHELIGLNSNGDNQISGVTDSNMTQTVMKELQGEWPHLSYQWLQQWYHLLFEKFDAN

SEQ ID NO: 3465 - protein, 312 aa, Staphylococcus epidermidis
AYHPLKNGVENKFLIISMYFNLKIKRMNKMKFKKSLITALATITLVPSLMILDTQHEAKAVGNYYYNGMEDHNASAAYHKAKKVDNSQIVIKRYNYAHKNKYKAVGRVSNMDGWKGPGKDSMGTGFMVGNHTFVTNAHVVDKKNGQRTSPSKIKFQLNRDGKKIPYQFHAKKIYKIPSYDMVVVETKENMAQKANVQPLKLATNQKIKSLKFNKKLYSLGYPVMNGNNTYAYWNKLRFLQEASNKSELMTKDKFRAGDSGSPMVDSQYVVYGVRTYGYNLRGSSNHPYAQQEVAGAESLYGNPRDFILKHNK

SEQ ID NO: 3466 - protein, 71 aa, Staphylococcus epidermidis
IKVPPFILNNNIPSLRIIENRIPGASCVGTSSSHNKGMNAFDIKVKIGVRDNRLTIRQIPIKIGKACTINI

SEQ ID NO: 3467 - protein, 207 aa, Staphylococcus epidermidis
LKKFLKGFILFFLIVMLGFAGGLGYSHYKDSKANTDVSSKETQTSNKNTHEDTISQDEMQNQVDSQTNEVSNETSTKTLSEKAKRLREAFNVNDEEAQILADEIDRADVNKDGTITMDEMTPTLDRFAKEGKFQPSAGGTTNEAHHPKYTAEDARNMSDDEFLDAYTEGMSDDEAATIHESAQESNEYMKFLRGQVEARAKGQGGNY

SEQ ID NO: 3468 - protein, 320 aa, Staphylococcus epidermidis
MKKLIQDKNTILKDMLDGITVSNNDVEVVSDTIVVRKHKKQSGVALVSGGGSGHEPAHAGFVAEGMLDAAVCGEIFTSPTPDKILDAIKAVDNGDGVLLVIKNYAGDVMNFEMAQEMAQMEDIKVESVIVRDDIAISDPEKRRGVAGTVFVHKYAGYLAEKGVALDEIKSKVEALLPDIKSIGMALTPPMVPTTGKNGFDIEDNQMEIGIGIHGEKGLHREDVQPINVIVERLLDQLYKEIEKKPLIVMVNGMGGTPLSELNIVTKYLDEQFNQNDIDVKQWFVGDYMTALDMQGFSITVLPFSEELSEALAAPTASKYF

SEQ ID NO: 3469 - protein, 280 aa, Staphylococcus epidermidis
WEKLFQRRTVALLLPWCIVRRFRLIMSNYQQKNNAVNTVVNVNQLSILDQEKVLLKDVDLTVTKGAFHCIIGESGSGKSLLTRTILGMKQSQLCYQGDIDIDLTQTDAVFQDVQSNMFQNITLAKHFQYIYEANRTHLTKQRIKEDVLQMMQLLGLRQGEQLLERYPFELSGGMAQRVAFIMSLIRRPNYLFLDEPTSALDQENIKKFMHYLLRAQERYQMTIVFITHDINLVKDCATHISIMQQGKLIENGEAASILTKPTHNYTKKLITIAHRRQPYA

SEQ ID NO: 3470 - protein, 76 aa, Staphylococcus epidermidis
APITIPITVFVAPKSCPLRGMKTLSMAFALKNINVKIYNLKKGQDMAPFILSLLRLIVVYQSVLLYNHFVAYAIHL

SEQ ID NO: 3471 - protein, 327 aa, Staphylococcus epidermidis
KKELKIMTLNLAQRVLNREPLTKEEALTIFESSELDTFDLLNEAYTVRKHYYGKKVKLNMILNAKSGICAEDCGYCGQSVKMKEKQRYALVEQDQIKEGAQVATENQIGTYCIVMSGRGPSNREVDHICETVEDIKKIHPQLKICACLGLTKEEQAKKLKAAGVDRYNHNLNTSERYHDEVVTTHTYEDRVNTVEMMKDNNISPCSGVICGMGESNEDIIDMAFALRAIDADSIPINFLHPIKGTKFGGLDLLSPMKCLRIIAMFRLINPTKEIRIAGGREVNLRSLQPLALKAANSIFVGDYLITGGQPNEEDYRMIEDLGFEIDS

SEQ ID NO: 3472 - protein, 129 aa, Staphylococcus epidermidis
FRWFTWFCWRTWFRWFTWFCWRTWFRWFTWFCWRTWFRWFTWFCWRTWFCWRTWFRWFTWFRWFTWFRWFTWFCWRTWFRWFTWFCWRTWFRWFTWFRWFTWFRWFTWFCFCWTILNNFVNRLFSDFFC

SEQ ID NO: 3473 - protein, 142 aa, Staphylococcus epidermidis
MEITSVNHICFSVSDLNTSIQFYKDILHGDLLVSGRTTAYLTIGHTWIALNQEKNIPRNEISHSYTHIAFSIDEEDFQQWIQWLKENQVNILKGRPRDIKDKKSIYFTDPDGHKIELHTGTLKDRMEYYKCENTHMQFYDEF

SEQ ID NO: 3474 - protein, 273 aa, Staphylococcus epidermidis
KHVTLLKVAHLGIKDTWSDETLVDNVNFTVQCGETLGIIGESGSGKSITCKALIGLNAQRLSVSGDIFFEHQNLNTITEKQLRKIRGKDIAMIMQQGTRAFDPSTKVGKQMIETLRAHTTLSKQQIKQELIHYMTYMKLKDPQSLLKAYPYMLSGGMLQRMMIALALALKPKLIIADEPTTALDTITQYEVINAFKDIKHHFDCAMIFISHDLTVINKIADRVVVMREGRVIEEGRTNMVLQQPRHHYTAYLLSTKKTIYDYFQFVLRGDFNA

SEQ ID NO: 3475 - protein, 309 aa, Staphylococcus epidermidis
FHYLKERNEMKRHFLAIGAITITTLLAGCDFGDLVGQHQSDKQSENSNTQTEQASNNKNSNSDNDHSNNNDESRDRVEDLTQSQKVALAINDPSVSQYVVNASELRNHSFYANYNGGGQRKSIHTYKLESLPKKVEGAPNDMTFYTAKPSKGSFVTLIGIGNEKVLIAGTQSSGTYQQYAHSEAARELDLHELLDKYGKSSNYKNLANQITFTQGQLSNASEYTSDEGTSNNDASNDDKVTRDNVIDKVEAYEGHQLDTDTYTFKEPEQNEDGDWGFSILDKEGNLEGSYIVTSDGEVTKYDENGEEIE

SEQ ID NO: 3476 - protein, 65 aa, Staphylococcus epidermidis
LLYFKIIIVFKYIILVISILIVSEIKFNSTTTQKREGEFVLSFLGFLKVNKKVLSNGMELLNIFS

SEQ ID NO: 3477 - protein, 327 aa, Staphylococcus epidermidis
VLYLEMTYCSLSIKIYTLKILIVLTIGGHVVIMSQFKDTLYKLFEPMMKIEFYQNLLVNLLIILAYILMGMIVIAISRKLVTKFFNVNEKKKNRHKIKRSETLSTLIQNLISYVVWFIVLTSILSRFGISVSAILAGAGVVGVAVGFGAQTIVKDIITGFFIIFEGQFDVSDYVQINASGVTIAEGTVKTIGLRSTRIQSDTGEIYTLPNGMISEIVNYSATDVSPIVMIPISPNENYKVIEEKLLTFLPTLKNKYDIFVSAPDLLGLDSVDGNEMVIKLLAHVKPGMHFPGQRLLRKEVIQYFSEEGIHIPKPTLVKLDKELNKKE

SEQ ID NO: 3478 - protein, 208 aa, Staphylococcus epidermidis
IMYLYVTKMTETLEEVELLLNRSSRQLKKPERIHYRFLKDRLMHQLGDALIQYAIEQCAGLTPKEWEYHITTMGKVEIRSSCHIYVSISYSYPYIICIIDNQPIGIDIEEMKDLDYKHLAKNFTKNEFNQVTTLKDFYEIWTKKESYTKLIGEGLMNGLDCYDVTQNLRFLKKHVQFTSVDYFKRLIQICHMSKHSLNFEVVPLTQLL

SEQ ID NO: 3479 - protein, 292 aa, Staphylococcus epidermidis
QFNLKIYIKKECFMQRQVVEFSKYNPSGNMTILVHSKHQPSEYAAIAHQLMATTHMCCEQVGFIESVNYENGDNYHLVMSGNEFCGNATMSYIHYLKERLLIQHQQFQLRVSGCSHPVECKVHSQHYEVTMPKVHQVKERFVKLGEQQFKAFEISYDTYIHYVMMCDDVDLAIKQCVEDFVSAQTWHRQFKTIGVMLFQQDKQFIYPLIHIPAIDSLIWENSCGSGAASIGVLVNYLTDHDIQDYLVNQPGGSIIVSSRKSGQNEYQTTIKGQVSTVATGQAYIEQETMTQI

SEQ ID NO: 3480 - protein, 503 aa, Staphylococcus epidermidis
YINLERNMHMSEANHKNIVVVGAGIIGTSVATMLSKVSPNWHIDMFERLEGAGIESSNENNNAGTGHAALCELNYTVEQDDGSIDASKAQEINEQFELSRQFWGNLVKNGDISNPEEFIQPLPHISFVMGPTNVNFLRKRYETLRTLPMFDTIEYTEDMETMRKWMPLMMENREPGHQMAASKIDEGTDVNYGALTRKLAHYLEQKSNVSLKYNHDVVDLTQREDGKWEVVVENRETKEKVTKIADKVFIGAGGHSIPLLQKSGVKQREHLGGFPISGQFLRCTNPDIIKQHAAKVYSKEPQGKPPMTVPHLDTRYINGKQTLLFGPYANIGPKFLKFGSNLDLFESIKPYNITTMLASAVKNVPLIKYSIDQMIKTKEGCMNYLRTFIPDAKDEDWELYTAGKRVQVIKDSEQHGKGFVVFGTEVVNSDDNSMIALLGESPGASTSLSVVLEVLEKNFADDKEAWEPVVKEMVPTYGRSLINDEKLMRETRRETSKNLHLNR

SEQ ID NO: 3481 - protein, 415 aa, Staphylococcus epidermidis
NKCYIQFERVAKNFSKGVLFMKKKLSYMITIMLAFTLSLALGLFFNSAHADSLPQKNGANQKTTKVTVSNKDVPDAVRKLAEEQYLSRVALLDKASNHKATSYTLGEPFKIYKFNKESDGNYYYPVLNKKGDVIYVVTISPNPSNSKASKQQNNYSINVSPFLSKILNQYKNQKITILTNTKGYFALTEDGKVTLVLKTPRNNEKTYENATESTKPKDLNDFKQTASVTKPTLEYQSTRNEMYAEYVNQLKNFRIRETQGYNSWCAGYTMSALLNATYNTNRYNAESVMRYLHPNLRGHDFQFTGLTSNEMLRFGRSQGRNTQYLNRMTSYNEVDQLTTNNQGIAVLGKRVESSDGIHAGHAMAVAGNAKVNNGQKVILIWNPWDNGLMTQDAHSNIIPVSNGDHYEWYASIYGY

SEQ ID NO: 3482 - protein, 298 aa, Staphylococcus epidermidis
EKRYRIGYFKKVQGIGKEVVPTVVIDLVDQLKVKYSIKLILEVLNIPKSTYYRWKNKTYKNDTVTQKVIELCKANHYTYGYRKITALINQCYTSPINHKRVQRMMQKHHLNCRVRPKKTTRIGKPYYKTDNLLQRQFKASCPIEVLTTDITYLPFGHSMLYLSSIMDIYNGEIVAYKIDDKQDQSLVNDTLNQIDIPEGCILHSDQGSVYTSYAYYQLCEEKGIIRSMSRKGTPADNAPIESFHPSLKSETFYINNELNRSNHIVIDIVEKYIKNYNNNRIQQKLGYLSPVKYRELIA

SEQ ID NO: 3483 - protein, 79 aa, Staphylococcus epidermidis
NTLYCTSKRIYITNNGGHHDFNYFIYLFLYSTHQLKDIYATRKTAKGRGRGGIWCEKFKISSHYACINLHECSYRNIHS

SEQ ID NO: 3484 - protein, 170 aa, Staphylococcus epidermidis
LDDFHLYQVIDFYYLLNALIYLVVLVHLIVLAYLVPLVYLVPLVYLIPLVYLVLLAYLVPLVYLVLLAYLVPLVYLVLLAYLVPLVYLVLLAYLVLLAYLVPLVYLVPLVYLVPLVYLVLLAYLVPLVYLVLLAYLVPLVYLVPLVYLVPLVYLVLLLLDHTQQFRQQVV

SEQ ID NO: 3485 - protein, 261 aa, Staphylococcus epidermidis
EKRYDVMKKYQTYIAIGSLLSLMVVLITYGLMQDTQHLNPLESPNGQHWLGTDQLGRDFLVRLIVGSLVTLSLTGIVILLSVCMGLIFGLIAGIERRWLDQIIMFVADMLLAIPSFIIALVILSLVSNSMIGLILALTIGWIGRYLRYFRNLTRDIQKRPFVQYARLSGNSTFKTTVTHVIPHLLSSIFALVTADFGKMMLSISGLAFLGLGIKPPTPELGTILFDGKSYFNGAPWLFFFPGVLLGGFALLCQIINKKITQ

SEQ ID NO: 3486 - protein, 493 aa, Staphylococcus epidermidis
MMDFWSSKRGKMLEITVLVFITIFGVGSQFFSNLAYSLNQGILQTSFGIGSQYLIIPSVLANFTFALGIPLGHTLTHKYGFKRNYLCFVFIFLIGSILGLLSFNLIILSIAKMIQSFSSGVLFFTLLPKLFLNFPKQYRNVFLLMVIVGLFGSNALGGLSGSLSLELDRWHWIFVVNIISAILCLILGNVILRKNEYHQTSDIHISRSMMITLVLSTISLMIPMSLLTQKGYHSLWVWPILLIAIFFIVNFIITNRQATHPIVHFHTLFSKKPFVGATMAISSHLTLLTGIAGINVYIVRILKLPFDISLHFYFFFFVGVIITGILKMFFYSSVGAGFLGTLGSSALLYVSIHWIILGNTINIPLLYIQGLLLGFGASMTLVSGSMATLLDGDLKEAAQRSQTMHTIRNFSAAMLIPIIAYTIKNHIQKGTQSIYAENITDKMIYLKKLQDVAIDADHQIFLLMIIFNMVMFVSSIIQMILGKGRRITPPRES

SEQ ID NO: 3487 - protein, 477 aa, Staphylococcus epidermidis
KEYHSMSNISMTTSKRNAIVTVMLISAFVSMLNQTILNTALPAIIKGLNITETTAQWLITGFMLVNGIMIPLTAFLMDKYSTRHLYIFSMAIFLIGSIVAAFSPTFTILMISRIIQAIGAGILLPLMQFTVFTLFPAEQRGFAMGLAGVVVQSAPAIGPTLTGLFVDLFSWRMPFYLVSAIAAVAFILGFFFVENNTKTKDIVLDKISVVYSTFGFGLILFAFSSVSTFGITSLPVIVTFVLGIAIIIIFTTRQLKLKHPLLNMRVFKNKVFTLSAVSSMLVYITMVSPALLIPIYIQTGLGQSALLSGVVVLPGAVINGLTMVYTGKIFDKHGIKVLVIPGFILLISMTFLYSFLTTGTPYWFVILVYTIRMIALGLLVMPLNTVGLNALESDDVSHGTAIMNSLRIIAGAMGTAVSVTILSIVAKQYTASHSTMSKMKLTQEATVHGIDVAFIFTTVLIIIGFILALFIKEEKNH

SEQ ID NO: 3488 - protein, 464 aa, Staphylococcus epidermidis
CELHMLKVTFNLRDGTFTDIPDDAHYFLIEDYDKLTPSQQTLLKRYIIKHQLDISLQHAILSSPLHSLNMIKKLETFVKESKAYHPQFHNIICGWCFIVLMFALPIYLSYHVSDGLQYYVSHWLTKLSQISLFQENKLQHILFGHYGVISLGTYSFVWALPVVFMISLSTALIDITHLKHYIVWSIEPTMMRLGLHGSDIIPLLEGFGCNAAAITQATHQCHRCTKVQCMSLVSFGTACSYQIGATLSIFNASHRSWLFLPYIGMVFLGGIIHNKLWYSHQTPKTTPSVFQRQLVRWPKPNLLLKAAWKSIQMFIVQALPIFIGICLIVSLLSLTPILTFISNAFIPLLWLLDVPTQLAPGILFSMIRKDGMLLFNMNGGTLIQRLSAFQLLLLVFFSSTFTACSVTMTMLMRRLGSILGIKMIMKQMVSSTICVTILVIAMLSITKISDLGVMLWKSLLSVVF

SEQ ID NO: 3489 - protein, 220 aa, Staphylococcus epidermidis
LRLHIGDNLMLKIERLTKYIDTQLIFKEISCTINDQHLLISGESGCGKSTLAKIIAGLDTDYQGELYLNGRLRESYTSKEWMKHIQYVPQYQRDTLNQRKTVLATLLEPLKNYKVNKQRYTSSIEAVLDQCNLPHDILNHKVSTLSGGQFQRVWIAKALILEPEILILDEATTNLDVINEEAILQMLISLKMTQLIIISHDTYVLSQFEGIQLQLNKLNN

SEQ ID NO: 3490 - protein, 127 aa, Staphylococcus epidermidis
TMKHHRCLLHCKQKKEAMQKHLNLSQRRQKKEAMQKHLNLSQRRQKKEAMQKHLNLSQRRQKKEAMQKHLNLSQRRQKKEAMQKHLNLSQRRQKKEAMQKHRMFQLSKLIQIMIHKHNFQKPLQEMT

SEQ ID NO: 3491 - protein, 281 aa, Staphylococcus epidermidis
LSFKNDTGGMKMTNRLILFDFDETYYKHRTNQADIPYLKEMESLLQNITAKNNVITAILTGSTIESVLKKMSKVNMSYKPQHIFSDLSSKMFTWNNCEYIESDEYKNEVLIEPFLLEDILDILKHVSSKHKVEFIPQRIFRENETLYNFYLYSSGDTHLDKTILEDLSQYSKTRDYTMTFNRCNPLAGDPENAYDINFTPKNAGKLYATKFLMNKYGVPKELIIGFGDSGNDEAFLSYLDHAMIMSNSQDEEMKSKFKNTKYPYYKGIYTHVREFIEYENV

SEQ ID NO: 3492 - protein, 304 aa, Staphylococcus epidermidis
CNIKSAFKGGNEMIVLRRLFQDRGAIFAIAIITIYVVLGVLAPLITFYEPNHIDTANKFAGISWSHWLGTDHLGRDVLTRIIYAIRPSLLYVFVALIISVVIGAILGFISGYFPGYIDAIIMRICDVMLAFPSYVVTLALITLFGMGVENIIIAFILTRWAWFCRVIRTSVMQYIEADHVKFAKVIGMNDLTIIRKHILPLTFTDIAIIASSSMCSMILQMSGFSFLGLGVKAPTAEWGMMLNEARKVMFTHPGMMMTTGVAIVIIVMAFNFLSDALQMAIDPRMSAKEKRLALKKGVKARDTA

SEQ ID NO: 3493 - protein, 474 aa, Staphylococcus epidermidis
KHCLIIHLKQLTKHNGDVKNYKHDRSRFLILHFIVKWHQKLVLNMSKILMVGSGPVAIQLARLCNLHGEHMVDMVSRVHASTKSKRVFDAYHRDGFFSVMTQNDAHQCFLGKFTVRHFFKDVKDITQYYDVVILACTADAYRPILQQLSKSTLKRIKQIILVSPTLGSHMLVKQILSDVHCEGEVISFSTYLGDTRIFDKAQPHCVLTTRVKSKLFVGSTHSQSITLYKLKSLFDYLNIELTTMDTPLHAEIHNSSLYVHPPLFMNQFSLKAVFEGTKVPVYVYKLFPEGPITMTLIHEMRLMWQEMMMILKKLKVPSVNLLKFMVKENYPIRDETMREVDIESFENLSAIHQEYLLYVRYTAILIDPFSNPDDQGAYFDFSAVPYKHVDTDEQGVIHIPRMPSEDYYRTLMIQAIGRALNVATPMIDTLLLRYETTVKQYCDTHLHQQLSKQFELHHFKQDLALVTNYLTFYK

SEQ ID NO: 3494 - protein, 378 aa, Staphylococcus epidermidis
YKYKRCFGGILMSKFIYQSPGRYVQGKGIVSSIAEETERLGSHALIIADEVVWNITEEKIKESFSANNNVDFEYEVFKGESSEEEIQRIVKQYKEKNIDVVIGLGGGKALDTGKAVAFELKASVIDFASTASMDAPTAAVSVIYNEDGSFSGYEFYPKNPDTVIVDSEIVAQAPVRLFASGMSDGLATLIEVESTLRRQGQNMFHGKPTLASLAIAQKCEEVIFEYGYSAYTSVEKHIVTPQVDAVIEANTLLSGLGFENGGLAGAHAIHNGFTALEGDIHHLTHGEKVAYGILVQLVLENAPTEKFMKYKTFFDNINMPTTLEGLHIENTSYEELVQVGERALTPNDTFANLSDKITADEIADAILTVNDLSKSQFN

SEQ ID NO: 3495 - protein, 66 aa, Staphylococcus epidermidis
FTDNAVYIVVTTAIPNAAPSVEVILIIPDAVPAFSAGTLDTAVDSAGVAKNPNPRPIKIKPIHATI

SEQ ID NO: 3496 - protein, 405 aa, Staphylococcus epidermidis
TTINLRSDNMKGAMSWPFLRLYILTLMFFSANAILNVFIPLRGHDLGATNTVIGIVMGAYMLTAMLFRPWAGQIIARIGPIKVLRIILLINAMALVLYGFTGLEGYLIARIMQGVCTAFFSMSLQLGIIDALPEKYRSEGVSLYSLFSTIPNLLGPLIAVGIWHVENMSIFAIVMIFIAVTTTLFGYRTTFANTQKEVSPKDEVLPFNAMTVYVQFFKNKALFCSGMIMILSSIVFGAMSTFIPLYTVREGFANAGIFLTIQAITVVIARFYLRKYVPSDGLWHHRFMMIVLTLLMVASVIVAFGPHIVSIFVYISAIFIGITQALVYPTLTTYLSFVLPKIGRNMLLGLFIACADLGISLGGVLMGPISDTVGFKWMYILCALLVTIAMTLSKIRQRQSVSKAS

SEQ ID NO: 3497 - protein, 341 aa, Staphylococcus epidermidis
FIHKELLLMKNLRNRSFLTLLDFSRQEVEFLLTLSEDLKRAKYIGTEKPMLKNKNIALLFEKDSTRTRCAFEVAAHDQGAHVTYLGPTGSQMGKKETAKDTARVLGGMYDGIEYRGFSQRTVETLAQYSGVPVWNGLTDEDHPTQVLADFLTAKEVLKKEYADINFTYVGDGRNNVANALMQGAAIMGMNFHLVCPKELNPTEELLNRCERIATENGGNILITDDIDKGVKDSDVIYTDVWVSMGEPDEVWQERLKLLKPYQVNQALLEKTGNPNVIFEHCLPSFHNAETKIGQQIYEKYGISEMEVTDDVFESKASVVFQEAENRMHTIKAVMVATLGEF

SEQ ID NO: 3498 - protein, 255 aa, Staphylococcus epidermidis
GGSKMLKGHLHSVESMGTVDGPGLRYILFTQGCLLRCLYCHNPDTWKINEPSREVTVDEMVNEILPYKPYFEASGGGVTVSGGEPLLQMPFLEQLFKELKANGVHTCIDTSAGCVNDTPAFNRHFDELQKHTDLILLDIKHIDNDKHIKLTGKPNTHILKFARKLSDMKQPVWIRHVLVPGISDDKEDLIKLGEFINSLDNVEKFEILPYHQLGVHKWKNLGIPYQLENVEPPDDEAVKEAYRYVNFNGKIPVTL

SEQ ID NO: 3499 - protein, 70 aa, Staphylococcus epidermidis
FVLKKQCYSIDNLIRRREYNVEHVSKLAEAIANTVSAAQAEDGAELAKSIVNIVANAGGIIQDIAHAFGY

SEQ ID NO: 3500 - protein, 77 aa, Staphylococcus epidermidis
IHKNTETFDDVSDIYHISLVDLSTCLFKSQLTSVIIYTTLFNNKTLFVKLNPHVVIYDVQLYLYDIKPENFSTTVMP

SEQ ID NO: 3501 - protein, 454 aa, Staphylococcus epidermidis
LMMKNKLTLKENLFIGSMLFGLFFGAGNLIFPIHLGQTAGSNVWTANLGFLITAIGLPFLGIIAIGVSKTNGVFEISSRISKIYGYLFTIGLYLVIGPFFALPRLATTSFEIAFSPFISSGTAQALLPIFSILFFGVAWLFSRKPSKILDYIGKFLNPVFLILLGIVVVLAFIRPMGGISHAPVSADYSNSVLLKGFIDGYNTLDALASLAFGIIIVTTIKKLGITNPNTIAKETLKSGTISIIAMGVIYTLLALMGTMSLGRFKVSENGGIALAQIAQHYLGDYGIIILSLIIIVACLKTAIGLITAFSETFTELFPKSNYLWLATGVSILACIFANVGLTKIIMYSTPVLMFIYPLAITLILLALLSPLFKHSKIVYRFTTLFTMVAAFVDGVKASPEFFVNTKFAQTIIGFGENYLPFFNIGMGWIVPAFIGFIIGIIVYFMTAKKSSHVQ

SEQ ID NO: 3502 - protein, 150 aa, Staphylococcus epidermidis
NKVKQSYYSHTPQSKIKSVAINKHAHQSISIGIVFVVVIFVSVIQILLHQRLKQNAPLERLYLVPYSQLKLYLTYISVHVVILMLMLLMISLLMHQPLSILFYLKTLIIVLFYEAGIALLLFKINVLSHRIFMAIIYTVAIGIIYLWIQL

SEQ ID NO: 3503 - protein, 74 aa, Staphylococcus epidermidis
ERPNYGMNLGHKSMFQVFYNVKTVMNFWALTECISIDKAIWLSTIKEWHNEGIMNICLILQLFSRKSNGLMVVK

SEQ ID NO: 3504 - protein, 175 aa, Staphylococcus epidermidis
EMRKCVLMTVAASATLLLAGCGNGQKEDKDVTVSLPTEAKADKLDAQGYDAAMPVYSAVYDALVKYDKDKGIKAGLADKWSVDESGKVYEFHLKKNVKFSDGSALDAKDVKFSIDRAKAMNKDSTVETLKKLDKVVVKNEHVVQIRLKSPSNQVLNELTQVRPLRIMSPHSVEGC

SEQ ID NO: 3505 - protein, 263 aa, Staphylococcus epidermidis
IRRKIDMSKTAIITGAAGGLGKGIAERLANDGFNIVLQDINEALLLETEKEFKEKGYQAVAFKSDVSKKKEQEELVQFAVTEFGQLDVMVNNAGVDAVTPILEIGEEELSKLFNINVFGTLFGIQAAANQFIKQKSKGKIINACSIAGHESYEVLGTYSATKHSVRSFTQTAAKELADKGITVNAYCPGVAKTEMWDRIDEEMVKLDDSLEIGDAFEAFSSEIKLGRYQEPSDVANLVSFLASNDSDYITGQSILTDGGLVYR

SEQ ID NO: 3506 - protein, 119 aa, Staphylococcus epidermidis
ISFDSWNIRCFCIASFFCLRWLRLRCFCIASFFCLRWLRLRCFCIASFFCLRWLRLRCFCIASFFCLRWLRLRCFCIASFFCLRWLRLRCFCIASFFCLQCRRHLWCFIVYSRLICVFK

SEQ ID NO: 3507 - protein, 445 aa, Staphylococcus epidermidis
CKIELRLIYMRLITFFKDLKSIICFNRERRMNVKQLSTTLKVRLICDFFQNIIVTAFLPFIALYLTDMVNQHFSGLFLFGLVMINFPISLISGHIIERLPKKTLTLSYQFILSLMLVIMAISISQHTFKIILFCIAYTIFSITIGMQQPIMDTIIMDAITPEVEQYIYKISYWLTNIAVAFGALIGGLMYGAHKSMLFFIAFVIYIMVFIALIVWLPKDLNIVTQSHTHHANEKQFSMGQILKSYKPAFKDTTYLLLIIGFSILTMGELSASSYISVRLKQEFDPMILFSLHINGVKMYSLLLMTNTIIVIIFTYFISKIVMRMNVKTALLVGIIFYVIGYSNLTYLNDFTLLIIFMIIATIGEMVYSPILEENRFKMVPSHKRGTYSAVHALGFNLAELLARFGIILGVFLTSMEMGIYMFVLLLLGGMSLYIAVSRFNNTNSQ

SEQ ID NO: 3508 - protein, 80 aa, Staphylococcus epidermidis
KTTDNNDFHNITPKSEILVMLNIAMTSMVTQIVDDTICFIIILIPRIEPSRRMSIVIVTEHAVNVELKKTSNNNWNAESL

SEQ ID NO: 3509 - protein, 175 aa, Staphylococcus epidermidis
PQLDDTTPFKKGVGIDLARLSLEKAETLKGQRPLTYYLTDKPQETKHVFDTAVSTSVLYLIEDIPQHAKDLKEVLKPGGVYYASFADLTNNPSRQFMDDTINQYGATPSQNHSLKHIVDSFVDAGFEVAVMKEHVPDVIDLTHYSDFYLSPNDYLQTLYEESFLIKASVKEGTEK

SEQ ID NO: 3510 - protein, 491 aa, Staphylococcus epidermidis
YKKDRGALNMKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQFNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKAITKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHVVLTPGRA

SEQ ID NO: 3511 - protein, 327 aa, Staphylococcus epidermidis
IMKENFWSTLPRPFFILAPMEDVTDIVFRHVVSEAARPDVFFTEFTNTESYCHPEGIHSVRGRLTFSDDEQPMVAHIWGDKPEQFREMSIGLADMGFKGIDLNMGCPVANVAKKGKGSGLILRPETAAEIIQASKAGGLPVSVKTRLGYYDIDEWRDWLKHVFEQDIANLSIHLRTRKEMSKVDAHWELIEAIKTLRDEIAPNTLLTINGDIPDRQTGLELANKYGIDGIMIGRGIFHNPFAFEKEPREHSSKELLGLLRLHLSLFEKYDKDEARHFKSLRRFFKIYVRGIRGASELRHQLMNTQSIAEARELLDTFEARMDARSEV

SEQ ID NO: 3512 - protein, 170 aa, Staphylococcus epidermidis
QTMEDIMILTILFIFFCIRLISLKISMQHAKQLKVEGAVEYGVKNSKYLAITHVLIYMSAAIETFIHKDTFNLLNGIGLIILIVAYIMLFIVIKTLGRIWTLKLFILPNHPIIKSGLYKVTKHPNYFLNIIPELIGVLLLTNATYTTLLLVPYAYFLIVRIRQEEKLMNI

SEQ ID NO: 3513 - protein, 325 aa, Staphylococcus epidermidis
SLKEDNMKNYKKYLIVLVLCLTVLSGCNLPGLKNSHSDDDVRITSLGTSESQIISHMLRLLIEHDTKGEIKPTLINNLGSSTIQHNAVTSGQANMSGTRYTGTDLTGALKEDPIKDPKKAMKATQEGFKKKYNQTFFNSYGFENTYALIVTKETAKKYHLETVSDLEKHAKDLRVGMDSSWMDRKGDGYPAFKKEYGYSFGTVRPMQIGLVYDALSSGKLDVAVGYSTDGRISAYDLKVLEDDRRFFPPYDASPLASDQLLKEKPELKPIVKKLEGKISTEQMQELNYQADGKGKEPATVAEDFLKKHHYFEDDDNKKDKQKGGQ

SEQ ID NO: 3514 - protein, 525 aa, Staphylococcus epidermidis
LSKEMKPLEQAINDNKKKKRFNFRMPGAFMILFILTVVAVIATWIIPAGAYSKLSYEPSSQELKIVNPHHQVKKVPGTQKELDRLGVKIKIEQFKSGAINKPVSIPNTYERLKQHPAGLDQITSSMVKGTIEAVDIMVFILVLGGLIGVVQASGSFESGLLALTQKTKGHEFMLIAFVSILMIIGGTLCGIEEEAVAFYPVLVPIFIALGYDSIVSVGAIFLASSVGSTFSTINPFSVVIASNAAGTTFTDGLYWRIGACIIGAIFVISYLFWYCKKIKKDPKSSYSYEDKAAFEKQWSVLHDDGSSEFTLRKKIILTLFVLPFPIMVWGVMTQGWWFPVMASAFLIFTIVIMFIAGTGQYGLGEKGTVDAFVNGASSLVGVSLIIGLARGINLVLNKGMISDTILHFSSSIVQHMSGPLFIIVLLFIFFCLGFIVPSSSGLAVLSMPIFAPLADTVGIPRFVIVTTYQFGQYAMLFLAPTGLVMATLQMLNMRYSHWLRFVWPVVAFVLIFGGGLLITQVLIYS

SEQ ID NO: 3515 - protein, 292 aa, Staphylococcus epidermidis
GSSFNCRNRTSIYRTGDNDANMNEHTKIENQLQYYLEQFTYLHQLVLEDSRHIVDLENLIDEYSQWILQPLAEHHYLTWNDLETKISFTKKLQEVSAKCVKQVEVIRAQRLLNGRASTSGYFENIEHCINEEFGRWQIGQNDKLLLIGSGAYPMTLIQVAKETGAAVIGIDIDSEAVDLGQRVVNVLAPNEDIVISNQTVDQLEDIQSVTHIIFSSTIPIKYDILNELYTLTNDEVVVAMRYGDDMKALFNYPSQATDETQWRCEELQTRPKQIFDIALYRKVASKVGVEHV

SEQ ID NO: 3516 - protein, 306 aa, Staphylococcus epidermidis
KIKLLEVLMMQKVVLTAAITGAGDTIQKNENVPVTPQELADSAIKCARAGATVAHIHVRDPETGGVSHDPELYAETVRLIREADEDIVINVTSGGGGDFIPSLEHPETGGEGTWIQTPEERFKPIGDLLPEMCTLDCGSVNMGDAIYLSPASWLRKQAQMVKDAGVKPELECFDTGHVSFAKQMIEEGLIDGDPMFQFCLGIPWGAENDPETIEYLKSRIPENAHWSAFGIGKMQLPTVRKVAQRGGNVRVGLEDNIYLRKGVKATNEALVEEAKRILAELDIEPLTPAEAREKFNLRNPHGKGDK

SEQ ID NO: 3517 - protein, 652 aa, Staphylococcus epidermidis
GKKLIEVIFLKNNNETRRFSIRKYTVGVVSIITGITIFVSGQHAQAAEMTQSSSDSNEQSQQTEQVEHKEDTTHLSNELNQEGETASQSKTSQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQCYMSMINNMLKVEELDGITRK

SEQ ID NO: 3518 - protein, 301 aa, Staphylococcus epidermidis
NFRLRSDVMEIIIIGGFLGSGKTSAINHLIADALENNLNPAVIMNEFGKRSVDGQLIERPEVPMSEITEGCICCAMKSDVSQQLHELYLKYQPDIIFIECSGVAEPLAVVDACFTPVLAPFITLRSMVGIIDASMYSRIKSYPQDIAALFYEQLRHCSTLFVNKIDKIEVEETARLLRQLERLNSDANIQVGQFGELNLKSLLEPTHINSNACGTLHSNINHQFIENPRLQTKEEMISALDNLPQDVYRVKGFVRFSDQQHVYLVQYAQGNIELSPIQLKNDVPLYLIVIGKHLKQIQLDL

SEQ ID NO: 3519 - protein, 239 aa, Staphylococcus epidermidis
TLKCNKFTLKIGDMINMNIFVTGTNTDIGKTYVTKYLYKALRTRGYRVCIFKPFQTEEIGGGRYPDLEIYKNECDLDYDVTSLYTFKDPVSPHLAFKIERHQQLNHQTMIDKLESLKAQFDMILIEGAGGIAVPIYEYSDHFYMTTDLIKDTSDFIVSVLPSKLGAINDAIVHQKYIDHQELPPNVLIMNNYTDSAIEQDNLHTIEKLIHKSVYTLGHQATQESFSEAFIQRIIGGSNG

SEQ ID NO: 3520 - protein, 267 aa, Staphylococcus epidermidis
IERCENMQHSSKIIVFVSFLILTIFIGGCGFINKEDSKETEIKQNFNKMLDVYPTKNLEDFYDKEGYRDEEFDKDDKGTWIIRSEMTKQPKGKIMTSRGMVLYINRNTRTAKGYFLIDKIKDDSNGRPIENEKKYPVKMNHNKIFPTKPISDDKLKKEIENFKFFVQYGNFKNLKDYKNGDILYNPNVPSYSAKYQLSNNEYNVQQLRKRYDIPTKKAPKLLLKRDGDLKGSSVGHKDLEFTFVENKKENIFFTDSINFKPTERDES

SEQ ID NO: 3521 - protein, 222 aa, Staphylococcus epidermidis
TERWSINMEGNLIQQLVHYYQMNFGYLWELFVNHLLMSVYGVLLACLVGIPLGIIIARFGKLSGVIITIANIIQTVPVIAMLAILMLSMGLGMNTVIFTVFLYALLPIIKNTYTGINEVDPNIKDAGKGMGMTRNQVLTMIELPLSLSVIIGGIRIALVVAIGVVAVGSFIGAPTLGDIVIRGTNATDGTLFILAGAIPIVIIVILIDVLLRLLEKKLDPAT

SEQ ID NO: 3522 - protein, 320 aa, Staphylococcus epidermidis
IAMLKRTIKFILYLIVSSFIIFILVEKTSGNPAILYLQRHGYTSITQDNIEAAQHQLGLGQHVLLRYIDWVGHALTGNLGYGFSTNEAVTAMIMEAIVPTLVLIIVSSCIMLPFGYIVGYFVGTRPHTRYANGIRGFAQVMTSMPEYWLAILFIYYLGVRWQLLPFVGSDSWQHFVLPIFTIVVIEGCHILLMTAHLITQTLDQDAYQLAQLRHFSLKARIIVQIKEIFAPLMTISINSIIHLIGKAVILEVIFSMSGIGKLLINAINQRDYPLIQGIVIFIIVFIMLMNYLGDVIILKNEPRLRRRHTQQSGNEKRGTM

SEQ ID NO: 3523 - protein, 109 aa, Staphylococcus epidermidis
KGVLMHNYNNINIVSDDSKYQEICWFHTLEGIWHPVEVETSPLNITFNKDITPNYVCTLINEDSRKIILSNVDNPNIIIEMILINSKKLVFNAISKEGLGTSPKITFTK

SEQ ID NO: 3524 - protein, 344 aa, Staphylococcus epidermidis
ILKRNNFDLGDVHMYKKGLILFFVAVLTLALAACGKDSHNQSSDHKGKLDVNTTVYPLKSFAQQIGGKYVNVESVYPKGVDPHTYDPSQKQMVDIGKSDLFLYTGDNLDPVAKKIAKAINDKDKTLSLESTLDKNKDLLKGEEHEHEHGEGHEHGESHEDEHEHEHHHHGKYDPHIWLDPVVSQKFAKAIKDELIEKDSKHKSYYEKNYNQLVKELKDLDKDMKHAVKGNEDKTVYISHDSIGYLAERYHFEQEGIENMNAEEPSQKDLTNIVKQIKEDKVKNILIEENVSHKVADTVRKETNAKTIKFYNMGSHTKQQDDDNNTYQSFMKENIKAIEKALQNE

SEQ ID NO: 3525 - protein, 64 aa, Staphylococcus epidermidis
SNILEGLRENNHATPKNKILKIGNNAWAVPDEINGENAISNDVVASLGNAKNGPITRYKPIVNK

SEQ ID NO: 3526 - protein, 466 aa, Staphylococcus epidermidis
RKSRRPLTMSEQFNKGKQLIVAIILGILTYWLFAQSFLNIAPHVQRFYHVDMSIVNIAVSLTSLLTGVFIVVAGGLSDKIGRVKITNAGLILSILGSIALIISHAPILLLLGRVLQGLSAACLLPATIALINSFFQGEERQKVLSYWSFGSYGGTGLASLFAGIIATFIGWRWIFVLSIIFSIIALILLRGIPESKDESAYNKKFDIVGIIIFVVMMLSINVVITQGDRIGWLNPLILILIAIFIVTLIAFYIFEKRQDEPFIDLSLFSNNVYIGTTLANLMVNMDIGSLALFNIYVQDDKHLSAAQAGLITIPYMLCSLLMIRVGERFMQKRGPQLPLMLGPVSITVGIILLAFTSLPNMIYYIVACIGFIFIGLGLGFFATPALSTAVSNVPAEKAGTASGIIKMTSTLGAAFGIAVVTTIYTALSVNHPAYLAATIAFIVGAGLVFIAFIAAYCLIPKKNVDI

SEQ ID NO: 3527 - protein, 315 aa, Staphylococcus epidermidis
KEVSEMAKIVVALGGNALGKSPQEQLELVKNTAKSLVGLITKGHEIVISHGNGPQVGSINLGLNYAAEHDQGPAFPFAECGAMSQAYIGYQLQESLQNELHSMGIDKQVVTLVTQVEVDEGDPAFNSPSKPIGLFYTKEEANRIQQEKGYQFVEDAGRGYRRVVPSPQPISIIELESIKTLVENDTLVIAAGGGGIPVIREQHDSFKGIDAVIDKDKTSALLGADIHCDQLIILTAIDYVYINYHTDQQQALKTTNIDTLKTYIEEKQFAKGSMLPKIESAISFIENNPNGSVLITSLNQLDAALEGKIGTLITK

SEQ ID NO: 3528 - protein, 111 aa, Staphylococcus epidermidis
IIRRFFSMKRASYSVETKYKAVEMKAAGFSTKEIMKELNIRNRTQVKTWWRWYRNGESYRFSQQVGKQYTYGKGLEELSEVEQLKLENKRKDIELDILKKYKALERKWYQQ

SEQ ID NO: 3529 - protein, 81 aa, Staphylococcus epidermidis
YNRRNSKMKVYKLNYQHHKDIVDDNVLTMFVTADNQDEVEAFAKKLHYKIEHLSPLTKKEFEDEKAKDSHYRLEHVDHYLN

SEQ ID NO: 3530 - protein, 1183 aa, Staphylococcus epidermidis
IHGRYNMGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAEEGGNAEAPQSEPTKAEEGGNAEAPQSEPTKTEEGSNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGKPAEPGKPAEPGTPAEPGTPAEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 3531 - protein, 64 aa, Staphylococcus epidermidis
RIYGYWSLIPKFSYYIFNEIPCHFHIFNSINNYIIFLKIKYIKIFFFIFNIIISVYLPTLPLAL

SEQ ID NO: 3532 - protein, 105 aa, Staphylococcus epidermidis
SSHGTICFKPSLIILSSSQITTLNIFIPPRQVVFGNTLMSLAGFLRKCADVHMFHIESWLYYVNDLNLGVSYQKHRDEGIGARVLNVMETYRCHYHEPEYVICAS

SEQ ID NO: 3533 - protein, 375 aa, Staphylococcus epidermidis
IQKGCTIMSHHRIIIIGAGAAGVGMAITLQEFNIKDVLIVEKGTIGHSFKHWPLSTKTITPSFTTNGFGMPNMNAIAKDTSPAFTFNEEHLSGKRYAEYLSLVATHYNLNVKTNTNVSRVTYIDGIYHVSTDYGVYTADYIFIATGDYSFPYHPFSYGLHYSEIQTFTQLKGDAFTIIGGNESAFDAAINLSQTGAKISIYTSKTGLKKEDADPSIRLSPHTQQRLQNAIQEGALIEMHVGYQARKITYQNHSYKIHFDNGHIVHSHTEPIIATGFDVTQNPLIEQLFQVRQSEVQLTELDESTKFPNVFLIGATVRHQNAILCYIYKFRARFAVLARIVSLREGLPEDTSLIQSYRQKNMFLDDYSCCDVNCTC

SEQ ID NO: 3534 - protein, 312 aa, Staphylococcus epidermidis
VERGSQKVKTLMIKAMGTVIRLSIEHQHPDTLLQEAEIKIRAWESQFSANDPKSDLMNVNQHAGIAPVKVSSEIFNMIRYGYETTLSSNFKMNILIGPLVKLWKIGFKDALKPKEVDIQRALLCMNPENLVLNSKTHEVFLTQSGMEIDLGAIVKGYFADQLQQYFLAHGVSSGIIDLGGNVLTIGRQPETLEKWHVGVRNPFHKDTLPLVTLSVEHQSVVTSGIYERYFIQENQLFHHILDSTTGYPVDNDIASVTIISDHGIDGEVWSTICSFGQSQKNIELLNLIDGIEGIIVTRDGSVLMTSKMQKYL

SEQ ID NO: 3535 - protein, 327 aa, Staphylococcus epidermidis
WDIMKVKLYTLLLLLIFLIACAPTSTSQSPHPLRTLIVYSPYPSHLIRPILNDFEKREHVKVEIKHGSTQVLLSNIHKEALSKRGDVFVGGVLSEMIDHQEDFVPYHNRSTLKQIEDYRSNNPLVTSFLLMPTVIVVNTDLQGDMTIHGYKDLLQSSLKGRVVYSNPHSTTTGYQHMRAMYHMRHQVSDVHQFQHHAVQLSKSSQVIEKVAKGAYYAGLSYEQDARTWKQKGYPISIIYPTEGTMLNVDGIALVNNAQPHPKRKKLVQYLTSRSVQQRLAEEFDAKSIRKDVTETNHSSIENLDHIPLIPQSRVSNIPHHQFLEMIQ

SEQ ID NO: 3536 - protein, 258 aa, Staphylococcus epidermidis
AKIMAHITLNYLSKTLGMHQTINVILPEDKSYFDTNENAKPLKTMLLLHGLSSDTSSYMRYTSIERYANTHQLAVVMPNADHSFYSNMAYGHSYYDYILEVYDYVHQILPLSKKREDNFIAGHSMGGYGAIKFALTQSYRFSKAAMLSAPYDVSMIGQYQWYDFTPEAIVGNTQHVAGTSFDPYYLVEQAIDNGQALPQLYITCGTEDELYQGNIDFVNYLDEKGIPYQFKKAPGNHDYAFWDKAIEDVIDRFTSSHI

SEQ ID NO: 3537 - protein, 64 aa, Staphylococcus epidermidis
TYVMYTKCYTCTLYSTSLFFLSKYGTTNITNKAHPIANKKPKFSNLFTPYFVYNINTIILQKYS

SEQ ID NO: 3538 - protein, 130 aa, Staphylococcus epidermidis
LVYIINILIFKILGDAQMLKINFFNKEYGVLKSQNYERISLELLNKHYHITENDFKNKDYCLDKFNSKDTFIGDIAHTEKELISLIEDNIKNPKNMEHQNLSSIFDYTDHHNNQRVYHSILDLIQDNTSS

SEQ ID NO: 3539 - protein, 257 aa, Staphylococcus epidermidis
SPYIHGYYLYGSDRYYIFMDSIVKESYSMIDIQNVSKSYKKKHIFDSLDMQFQNHKITILLGENGAGKSTLLRLIAGIENADEGRIQYFNQYLSRRRIRHIVGYVPQDIALFEHMTVMENIEFFKSLCENPISDETLHSYLSQLNFTDTKVKVSNLSGGNKRKVNIMIGLLSRPKILILDEPTEDIDLESRYDIHNLLQQMTDQCLIIMTTHHLDEVEALADDIKVIGQNPFYHDILENKGWSFKKYANALADNTKS

SEQ ID NO: 3540 - protein, 72 aa, Staphylococcus epidermidis
IINIEATQYEGRAVSRKAIERIARSGNLPLVKALTMPSTTDVIITTTLEIKVSFNVFINAGPIRSDTGSPVI

SEQ ID NO: 3541 - protein, 131 aa, Staphylococcus epidermidis
EANISLKIRCISMKRLIFIVVILFIQACSYVVINFFFFDMWVIHSSEQQLNQSIQHHDTKQLHKIAKDKQTYQFLKTIKKADFENATDNQGGGPIGYYRLDINKKPVGLTINIKYNFLPEKTTIKSIKLYQ

SEQ ID NO: 3542 - protein, 1017 aa, Staphylococcus epidermidis
CENIHKKLGGFAMSKEIFDTFKFKCGAELKNRVLMAPMTIQAGYFDGSVTSEMIDYYQFRAGDASAIIVESCFVENHGRGFPGAIGIDNDDKIPGLKRLAEAIQAKGSKAILQLYHAGRMANPKFNEGEQPISASPIAALRPDAVPPREMTHAQINQMIDDFGEATRRAIEAGFDGVEIHGANTYLLQQFFSPHSNRRQDSWGGSREKRTRFPIEVLTKVQHVVAEKEASHFIIGYRFSPEEIEEPGIRFEDTMFLLNTLAEYEPDYFHISANSYQRTSIVNQEDTEPLINKYIKMQSAQLAKIPLIGVGSIAQRQDAEHALELGYDLLSVGKAYLVEPQWTDKISQNEEVEQFVDIHDQKVLHIPSPLWKVMDFMILDKEEEHRKYEKLKALQNKKVKFNKGTYHVYAKGHNGNLPMKVQLSEDKIVSIEVDDSGESEGIANPVFERLPQDIINGQTLNVDVISGATVTSEGIVQGIADAIEQAGEDPDILRARPKPVVQWSDEVVEETTDVVVIGTGGAGLSAAATVLDEGKEVIMLEKFAAIGGNTIRTGGQVNAAEPKWQNAFPALAGEKETLIQLLNHDENDIDEAYIEDFNTLKRQIKDYLENSSNEDEYLFDSVELHRIQTYLGGKRKDRNNVEISGDYDLVKTLTDNVLESVYWLKDKGVHFDRSFVDMPVGALWRRGHKPMKAQGLEYIENLGDYVKHNHGRIFTETTAEKLIKEGNQVVGIEARKANGAKVKIHTRHGVVLATGGFGANTKMLQQYNTYWDNIPDDIKTTNSPAITGDGIRLGVQAGADIVGMGFSQMMPISDPKTGALFTGLIVTPSNFVFVNKEGQRFVNEFESRDVLSKAALEQKDGIFYIIADANIKALAMNTTEDKINQELEDGTLVKADTLEALAQKLNIDTTTFVNTIERYNTFVEQGQDEDFNKNAFDLKIEKAPFYATPRKPAIHHTMGGLKINTHAQVIDVEGHIIEGLYAAGEVAGGIHAGNRLGGNALADIFTFGRIAGQSAVTK

SEQ ID NO: 3543 - protein, 63 aa, Staphylococcus epidermidis
YEILSCTFTPSLHQYLTSKRLALSSYISRLKRQALINFIHIYLSCLTYLYTNPPSVKMDWPVI

SEQ ID NO: 3544 - protein, 406 aa, Staphylococcus epidermidis
VCLIKKLKKWLKFSTKPYIKHWVRSKRGFMDIKAQLKQIQDKGLYRELQPIQSVEKQYIYINDQSYINFTSNDYLGIGQLEYQPQNFLDFIKTYSIHLSSSRLVSGNSVVYQQLEQAISEHFNFEDALIFNSGYDANLAVFNIFKNNNVVIFSDQQNHASIIDGIKLSGLSKVIYQHLNYDDLESHLARHTNPDVQKVIVSDSVFSTNGTKADINRLVHLKQRYNAILIIDASHSLGLNLFEYHADIDIVTSSLSKAWGAHGGLILSSKDIKDLIINKGRSLIYSSSLPSYHLYFIQVSLQHVIEDTYRREKLNALSEYFNHQFMELFPNQPLSNTPIKNIVCDSLASAQAQYDMLFEHGIFVSYLRYPTVSQPTLRISLSYFHDTDDINRLFNVMKQYDEGDSYV

SEQ ID NO: 3545 - protein, 106 aa, Staphylococcus epidermidis
CDFFKKMCRKILVYKHTITVIKGFFLHTSHNFFNTPLLSIVIEFNYIPFDIGKLNKTFQTYKQLNIPLLFKRILSNELYTIIKVLQKFESLNFTYFIYIAHFIIML

SEQ ID NO: 3546 - protein, 294 aa, Staphylococcus epidermidis
GESMNKLSKYIAIATLASTVTISAPIHTYACESHTKDNHNQTTQHQNDPNLGEQNVMAVSWYQNSAEAKALYLQGYNTAKYQLDEHIKKNKGKKKLAIALDLDETVLDNSPYQGYASMHDTSFPEGWHEWVAAAKAKPVYGAKSFLKYADKKGIDIYYISDRDKEKDFKATKENLKNIGLPQAKDNHILLKGKNDKSKASRRQQVEKNHKLVMLFGDNLLDFTDPKKSTAKEREKLVKKHAKDFGKKYIIFPNPMYGSWESTLYHNQYEISKNEKDELRKASIKQFNPKTGEVK

SEQ ID NO: 3547 - protein, 454 aa, Staphylococcus epidermidis
EDPMANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAKRYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIKGRGLMYGVELVENKSTQTPLDIPTVELIIRRCKENGLMIRNLENVITFVPILSMSNKEIKKMVKIFNKALHQTLGKK

SEQ ID NO: 3548 - protein, 195 aa, Staphylococcus epidermidis
IITIIYYLEFDKEGDEMPRISKRQLILESAAAIINEKGADYLTLDAVAQRAGISKGGLFYHFKSKDELIKELVNYANNLYRENVNQHIGNEKNKKGQWLNAFIEATRAHRTDNAPITSGMLAAQGTNRSLLSPLKTSYQEWQYQITHDGLDEVDATIIRLAVDGLWLSEIFGISAIDEEMREKVIERLKMQIEKK

SEQ ID NO: 3549 - protein, 271 aa, Staphylococcus epidermidis
MYTIIERCEKMKYYGKCISYISILILTFFIGGCGFMNKENNKEAEIKENFNKTLSMYPIKNLEDLYDKEGYRDEEFEKEDKGTWIINSEMNIQKKGQAMKSRGMVLYMNRNTRKTTGHFYTNIITEDKKGRVHSKDKEYPVRLKNNKIEPTKSIADEKLKNEIKNFQFFSQYGNFKNLKDYKNGNVSYNPNVPSYSAEYQLSNEDDNVKQLRKRYDIPIKRAPKLILKGDGDLKGSSIGYKDIEFSFVDNKEESVYFVDSLEFNPSDVNNE

SEQ ID NO: 3550 - protein, 64 aa, Staphylococcus epidermidis
VIQMNHFGKLHRISLILNIMFLILMPKIYSFDNIYLSIIWTLLGIANAVYLLIKQKQENTIKRK

SEQ ID NO: 3551 - protein, 325 aa, Staphylococcus epidermidis
RRQIMKFAVVGTGVIGSGWITRMLAHGHEVIATDPSEGAYERMLTQVKQNWPYAEQMGLAENASIQNLTFTPHLEEAVKDADHIQENVPEVEEIKDAVLKEIDFYAKPEATIGSSTSGIMPSELQANLSHPERLVVAHPFHPVYILPLVEIVPGKQTSEETTVKAEQIYESIGMDVLHVRHEIEGHIADRLMEALWRESLHIVNDGIATTEEVDKAFTHAAGLRYAQYGPFMTFHLAGGEGGMRHMLKQFGPALKKPWTKLIAPELTDDLYHKVVSGSEASSQGYTMSELDQKRNEFLIKVKELAEQYWPSDSKAMKKSNGAELQ

SEQ ID NO: 3552 - protein, 418 aa, Staphylococcus epidermidis
KVKIITKNEEDCEMTVLSEQDKIRLLADIVKIQTENDHEIEVCEYLKDLLSQYDIDSKIVKVNDSRANLVAEIGSGAPVLAISGHMDVVDAGDHDDWTFPPFELTDKDGKLFGRGTTDMKGGLMAMVIAMIELKQSNALKQGTIRLLATTGEETEQYGAQLLADEGYLDDVSGLIIGEPTSNIAYYAHKGSMSCVVTAKGKAAHSSMPHLGTNAVDILVDFVNEMKQEYKNIKEHDKVHELDAVPMIEKHLHRKIGEEESHIYSGFVMLNSVFNGGKQVNSVPHKATAKYNVRTVPEYDSTFVKDLFEKVIRHVGEDYLTVDIPSSHDPVASDRDNPLIQNITRIAPNYVHEDIVVSALIGTTDASSFLGTNENNVDFAVFGPGESIMAHQVDEFIRKDMYLSYIDVYKDVFKAYLEK

SEQ ID NO: 3553 - protein, 756 aa, Staphylococcus epidermidis
QYEMEAESMLETNNHTNAWQGFKTGRWNKNIDVREFIQLNYSLYEGDDEFLEGPTKATETLWDQVMQLSKEERERGGMWDMDTKVASTITSHDAGYLDKDLEKVVGVQTEKPFKRSMQPFGGIRMAKAACEAYGYELDPETEKIFTEYRKTHNQGVFDAYSREMLNCRKAGIITGLPDAYGRGRIIGDYRRVALYGVDFLMEQKLKDFNTMSTEMSEDVIRLREELSEQYRSLQDLKELGQKYGFDISRPATNFKEAVQWLYLAYLAAIKEQNGAAMSLGRTSTFLDIYAERDLQNGDITEQEVQEIIDHFIMKLRIVKFARTPEYNELFSGDPTWVTESIGGVGIDGRPMVTKNSFRFLHSLDNLGPAPEPNLTVLWSTRLPENFKIYCAKMSIKTSSIQYENDDLMRESYGDDYGIACCVSAMKIGKQMQFFGARANLAKALLYAINGGKDEKSGKQVGPSYEGIKSDVLDYDEVFERYEKMMDWLAGVYINSLNIIHYMHDKYSYERLEMALHDTEIIRTMATGIAGLSVAADSLSAIKYAQVKPIRNEEGLVTDFEIEGDFPKYGNNDSRVDEIAVDLVERFMTKLRSHKTYRNSEHTMSVLTITSNVVYGKKTGNTPDGRKAGEPFAPGANPMHGRDQKGALSSLSSVAKIPYDCCKDGISNTFSIVPKSLGKEEADQNKNLTSMLDGYAMQHGHHLNINVFNRETLIDAMEHPEEYPQLTIRVSGYAVNFIKLTREQQLDVISRTFHESM

SEQ ID NO: 3554 - protein, 167 aa, Staphylococcus epidermidis
RSGITMMNQQYVFHTKVHRDWVDHNGHLNDAMYNRIFSDTTDDWLGHLGLTINAIQSYQYTVFTLENHVMFLNEMKENEDVIVKVHLHDYDSKRLHVLMEMFNADDDLCATYEVMLMGIDTTSGRPSAFPNDILNNIEHYYNIENVEMTSQYIGHRIGIKKKPKSKE

SEQ ID NO: 3555 - protein, 84 aa, Staphylococcus epidermidis
YVMMDFLHYILPVIIYAVLLAIHYFLSRTGNKILGLIVPVGVIASLVYMYQADIIHMKMIGVIIIGIVALLFLAEEWQRAQKDK

SEQ ID NO: 3556 - protein, 213 aa, Staphylococcus epidermidis
DTMIKFISEHSGMLFAKTFEHLYISIVALVIAMIVAVPLGILLSKKEKLSKVSLTIAGVLQTIPTLAVLALMIPLFGVGKTPAIIALFLYVLLPILNNTIIGIQNIDSNLREAGRSMGMTNFQLMKDVELPLALPLILSGIRLSSVYVISWATLASYVGAGGLGDFIFNGLALFEPSMIITATILVTAIALIVDYVLSLIEKWVVPKGLKVSR

SEQ ID NO: 3557 - protein, 63 aa, Staphylococcus epidermidis
LNSITIDSKGVLKKLCEVWRKKPLITVIVCLYTRILRHIFLKKSHYQKLKNIIIINVVKNVLD

SEQ ID NO: 3558 - protein, 236 aa, Staphylococcus epidermidis
NNTMKVIAMYSIKMRASHEDVHISGAETMCEFEDLENYLKKYFNKAFNHENGNIDFLNLKIEKVKAPIQTLVALPVVENLNDTLTQLAKQTGVSEYALNKGLEFIKNDITYTGAIILSAQTGQRLDSTEQRGIRVTQLAFKTCKCNGEISERVKDARALATCINAFEGVKAELCVSDDLHYTTGYFASPKLGYRRIFNIKEKGTRHGGRIIFVDEGINLNEYVSFLETVPKEIIEK

SEQ ID NO: 3559 - protein, 192 aa, Staphylococcus epidermidis
RMNVADIKARLLDLENTFKEKESELTDLDRAIGDGDHGVNMVRGFEHLKEKIDDQSMQALFKSTGMTLMSNVGGASGPLYGFGFIKMASAVNDEIDHDNLKEVLKAFADGIQQRGKVELNEKTMYDVIERAREAVEKNETVDLDKLQSFANETKDMVATKGRASYFNEASKGYIDPGAQSSVYILNAIIGGE

SEQ ID NO: 3560 - protein, 75 aa, Staphylococcus epidermidis
NICFLYLIYHNIVQFNLKFTMFNIYSSFYILYKKHGLYLTVCSFTFRPTICLSNQSKTYFYVTFVNCSRFTTTKY

SEQ ID NO: 3561 - protein, 315 aa, Staphylococcus epidermidis
RSVVMVKFIMKRLTLMIPLLIVVTFMTFMMTYLTNEDPAVTILHAQGTPNITQDLIAETKEKYGLNQPIFTQYKNWLVDALQFKFGTSYITGDPVSERMGPAFMNTLKLTLISSVVVMITSVVLGIVSALTSGRFPDRAIRSIAFLLTALPSYWVASILIIYVSVKLNLLPTSGLTGPESYILPVFVITITYAGIYFRNVRRSMLEQLNEDYVLYLKASGVPRLTMLLHVLRNALQVAISIFCMSIPMIMGGLVVIENVFAWPGLGPLSIKAITEHDFPVIQAYVLIVAVLFILFNTLADIINAILNPRLREAMK

SEQ ID NO: 3562 - protein, 257 aa, Staphylococcus epidermidis
LTMVNIMEKFKLTGKVAMVIGGATGIGKAMAEALAQAGANIVIADLQSNIGQETATTISTQSGVKTTSLKLDITHLDEVNQIVDYVVREYGKIDILVNNASISIQDDTENISYEEWLKEINLSLNGAFSVAQTVGRQMIEKGSGSMINVSSVLGLIANKTQDQSSYETSKAGVTMLTKSLAREWSRYGIKVNAIAPGYMRTIETEKILNDNTETNTTPMERVGEPEELAGITVYLASDASSFTQGSVFNIDGGYSAL

SEQ ID NO: 3563 - protein, 194 aa, Staphylococcus epidermidis
LILLQEKKLAKVNQQKKSLNNLLTKLLSMVQQKQNQVNQRNQVNQRNQVNQRNQVRQQNQVNQRNQVRQQNQVNQRNQVNQRNQVNQRNQVRQQNQVRQQNQVNQRNQVRQQNQVNQRNQVRQQNQVNQRNQVRQQNQVNQRNQVNQWNQVNQWNQVRQHNQVHQNNQIDQCIQQIIKINYLIQVKIVKLMREL

SEQ ID NO: 3564 - protein, 473 aa, Staphylococcus epidermidis
CDIFFLTKMIGVLGMNFFDIHKMPNKGIPLSVQRKLWLRNFMQAFFVVFFVYMAMYLIRNNFKAAQPLLKEEIGLTTLELGYIGLAFSITYGLGKTILGYFVDGRNTKRIISFLLILSAITVLIMGFVLSYFGSVMGLLIVLWGLNGIFQSVGGPASYSTISRWAPRTKRGRYLGFWNTSHNIGGAIAGGVALWGANTFFHGNVVGMFIFPSVIALIIGIVTLFIGKDDPEELGWNRAEEIWEEPIDQENIDSQGMTKWDIFKKYILGNPVIWILCISNVFVYIVRIGIDNWAPLYVSEHLHFNKGDAVNTIFYFEIGALVASLLWGYISDLLKGRRAIVAIGCMFMITFVVLFYTNATSVTMVNISLFALGALIFGPQLLIGVSLTGFVPKNAISVANGMTGSFAYLFGDSMAKVGLAAIADPTRNGLNIFGYTLSGWTDVFIVFYVALFLGMILLAIVAYYEEKKIRKLKI

SEQ ID NO: 3565 - protein, 543 aa, Staphylococcus epidermidis
VYIFSKRKRKTMNKLTKLSTVIFVSGIILAGCGSNKELTEKKENKVLSYTTVKDIGDMNPHVYGGSMSAESMIYEPLVRNTKDGIKPLLAKKWDISPDGKTYTFYLRDDVSFHDGTKFDADAVKKNIDAVQQNKKLHSWLKLSTLIDDVKVKDKYTVQLHLKEAYQPALAELAMPRPYVFVSPKDFKHGTTKDGVKSFDGTGPFKMGEHKKDISAEFNKNNQYWGEKAKLNKVEAKVKPAGETAFLSMKKGETNFAYTDDRGTDSLDKDSLKQLKETGSYQVKRSQAMNTKMLVVNSGKKDSAVSDKAVRQALGHMVNRDKIAQDILNKQEKPATQLFAKNVTDINFNLPTRTYDKKKAQALLDKAGWVLSKDRQVRQKEGKDLNLKLYYDKGSSSQKEQAEFLEAEFKKLGVQLDINGETSDKVAERRSSGDYDLMFNQTWGLLYDPQSTLAAFKTKTGYESATLGIKNKSQLYKDIDEAFKIQDAKARSKAYQQILKQVDDEGVFIPITHGRMTVVAPKDLQKLSFTQSQYELPFNEMQYK

SEQ ID NO: 3566 - protein, 171 aa, Staphylococcus epidermidis
FMILCFFCKYSICQIFIMYESYTHSSQIRGSYSMSKKKILIFISVILIIFGGVYLKMKYDEKAKQKEIYYKEQQERITLYLKYNTKKPNTIKSVHFTSLKQGPMGDAIIEGYINNNKENEFVAFASSEDNFQFQGDMIESKKVSNLIKYQTKTPDEIKKDLDKKKNAKDFY

SEQ ID NO: 3567 - protein, 69 aa, Staphylococcus epidermidis
CPPLFVIYILLLVQYKVFYIENVSNAINYLLTLAPTHNSSNTSHIKFSFSDNLILLRILSAYIDVIYFF

SEQ ID NO: 3568 - protein, 341 aa, Staphylococcus epidermidis
TVKFEKAIGTGAFVVDKTVKEKTTLKPNKYFDHGHPINYHLAFQTIEDGDSRNSPVQSGFVDISGGALGMLSDEQIKQDKKNKNLTIEDRPSTVSHFMAFNPKNDVLNQRTIREAISKSIDAKDIAGKSVNGLFQKNVQFVTKNNQQPHDYDMKAAERLLKSEGYHKNDDGIFEKNGKPLSFNLVIQTAEFPNWKDKAEKVQRQLKQAGIKLNVKTLDSQSYYDTLWTKKDYDLIFYRTYSDALMPYNFISSVFKNNDGQPGVLADDETLTKQLDDFPSTVSKEDQQCSFDDIFKHFNQQYYGVPIAYPNETFVVSDKVKQFKFSGLTDAPIDYKALKVNE

SEQ ID NO: 3569 - protein, 253 aa, Staphylococcus epidermidis
GVISMLKVQNVIKFYGKKSMFRDKRIPVVKGVSFDCPTGASVAIIGESGSGKSTLSRMILGLEKPDQGQVTLDGQPVHLKKVRRHRIAAVFQDYTSSLHPFHTVKDILFEVMNQCRCTSKENMEEYVTVLLREVGLKSDCLYCYPHMLSGGEAQRVAIARAICMQPDYILFDEAISSLDMSMQTQILDLLKRLRHSHQLSYIFITHDIQAATYICDDLLIFKNGCIEARTSISELHRQQNGYTRELIDKQLSI

SEQ ID NO: 3570 - protein, 406 aa, Staphylococcus epidermidis
QIELPIERNGHMLSIKNLSKVYAGGKKAVDNMTIDIESGDFIAFIGTSGSGKTTALRMINRMIESTEGEITIDGKNIKELNPVELRRSIGYVIQQIGLMPHMTVKENIVLVPKLLKWSQEKKDEKAKELIRLVDLPEEYLDRYPSELSGGQQQRIGVVRALAAEQDIILMDEPFGALDPITRDTLQDLVKKLQQQLGKTFIFVTHDMDEAIKLADKICIMTNGQVVQYDTPDNILRSPANDFVRDFIGQNRLIQDRPNIRTVKDAMIKPVTVHVDRSLNDAVNIMREKRVDTIFVVGNDEHLLGYLDIEDINEGLRHHKELIDTMQRDIYRVRIDSKLQDSVRTILKRNVRNVPVVDSDNKTLLGLVTRANLVDIVYDSIWGELESDNNDNHSGIVEPESTGVETP

SEQ ID NO: 3571 - protein, 286 aa, Staphylococcus epidermidis
SHDSIWNICTSAHFLKKPARDINVLPNTTCLGGIKMFKVVICDDERIIREGLKQMVPWEDYHFTTVYTAKDGVEALSLIRQHQPELVITDIRMPRKNGVDLLDDIKDLDCQIIILSSYDDFEYMKAGIQHHVLDYLLKPVDHTQLEHILDILVQRLLERPHSTNDDAAYHTAFQPLLKIDYDDYYVNQILSQIKQHYHKKVTVLDLINPIDVSESYAMRTFKEHVGITIVDYLNRYRILKSLHLLDQHYKHYEIAEKVGFSEYKMFCYHFKKYLHMSPSDYNKQSK

SEQ ID NO: 3572 - protein, 84 aa, Staphylococcus epidermidis
SAFLSILSPLFKGSTWKRTSKPPCKSRTKLTFLTTFLYVIPIPVNSRAMRSMNAIILLVFFTCTPHYLLMYLEYSMNKLSCKLK

SEQ ID NO: 3573 - protein, 109 aa, Staphylococcus epidermidis
GVTSMKTLKLLKKTRAFTLIEMLLVLLIISLLLILIIPNIAKQTSHIQSTGCDAQVKMVNSQIEAYALKHNRNPSNIDDLVSDGFIKEGQKTCKSGQTISIANGEAVAN

SEQ ID NO: 3574 - protein, 531 aa, Staphylococcus epidermidis
LIMSKIYCIKVIKTLLYQRYIEVTGYKDESEKDKMDKQERYNRRENIRNFSIIAHIDHGKSTLADRILENTKSVETREMQDQLLDSMDLERERGITIKLNAVRLKYEAKDGETYTFHLIDTPGHVDFTYEVSRSLAACEGAILVVDAAQGIEAQTLANVYLALDNDLELLPVVNKIDLPAAEPDRVKQELEDVIGIDQEDVVLASAKSNIGIEEILEKIVDVVPAPDGDPEAPLKALIFDSEYDPYRGVISSIRIIDGVVKAGDRIKMMATGKEFEVTEVGINTPKQLPVEELTVGDVGYIIASIKNVDDSRVGDTITLAERPADKPLQGYKKMNPMVFCGLFPIDNKDYNDLREALEKLQLNDASLEFEPESSQALGFGYRTGFLGMLHMEIIQERIEREFGIELIATAPSVIYQCILKDGSEVSVDNPAQMPERDKIEHIYEPFVKATMMVPNDYVGAVMELCQRKRGQFINMDYLDDIRVNIVHEIPLSEVSFSISLINLNLTQKGMLLLIMNLLRIKKVILLKWTYY

SEQ ID NO: 3575 - protein, 336 aa, Staphylococcus epidermidis
ANMSGQVILLLDEIHRLDKAKQDFLLPHLENGKIVLIGATTSNPYHAINPAIRSRAQIFELYPLDQDDIRLALDRAINDKERGLSTYHPIVDEDAIEYFSTQSQGDVRSALNALELAVLSAHIGEENERHITLDDAKDCLQKGAFVSDKDGDMHYDVMSAFQKSIRGSDVNAALHYLARLIEAGDLPTIVRRLLVISYEDVGLASPNAGQRTLAAIQSAERLGFPEARIPLSQAVIELCLSPKSNSGITAIDKALGDIRNGHIGQIPDYLKDGHYSGAKKLGRAIGYKYPHNYENGHVVQQYLPEKLKNRVYYEPKTTSKSEQQFKTIYDNLRNKT

SEQ ID NO: 3576 - protein, 248 aa, Staphylococcus epidermidis
RIRSGSILVMNQYEDMSLVYDKLTQDQPYHSWFNIVEHFLPSDSHDLLDIGCGTGNLTQLLTSLGEVTGMDISVDMLSIARQKTNQVKWIEGNMTHFNLNKKFNMITIFCDSLNYLETLNDVKMTFERVYQHLNKNGVFIFDVHTVHKMKTLFNNKSYIDESDNVFVGWDAICGDEPLSVYHEMTFFVSQQNGLYQRFDESHYQRTYEEQIYRNLLKDVGYHSVKTFTDFNIHSHEEDAHRLFFVAKK

SEQ ID NO: 3577 - protein, 174 aa, Staphylococcus epidermidis
WYFPSGHVENIHFVSHAQLNNINLNKIANFLTEHFSFNRKVLTQNIESYFSQKEELLLANEVVEMINLQIGNQSNSIYMGGKVKLIDALNESNVSSIQPILQYIESNKITELLEDISTSQINVRIGKEIDDSLSDISIVTSQYHFDESLKGQIAVIGPTAMHYQNVIQLLNRIW

SEQ ID NO: 3578 - protein, 226 aa, Staphylococcus epidermidis
FFVFNINRRYIDFFMKWKLYILIILIMLTTFFFYLLNDNNNDLIQNSQERQSKISDQQIKNSKKLNKKEVSIQKDNTKETKIFIDIKGAVKHPNVYEMSSSNRVIDALNKAEVLKDADLSQLNLSEKLVDQKLIYVPKKGENSMKINSQQSTLNSSDVKINTNQPLNLNSATEEQLKNIPGIGPSKAKEILNYREQNHGFNSIDDLMKIKGFGKKTFEKLKEHFTI

SEQ ID NO: 3579 - protein, 467 aa, Staphylococcus epidermidis
GEAFMVKNMDTIVQLAKHRGFVFPGSDIYGGLSNTWDYGPLGVELKNNIKKAWWQKFITQSPYNVGIDAAILMNPKTWEASGHLGNFNDPMIDNKDSKIRYRADKLIEDYMQNEKGDENFIADGLSFDEMKKIIDDEGIVCPVSKTANWTDIRQFNLMFKTFQGVTEDSTNELFLRPETAQGIFVNYKNVQRSMRKKLPFGIGQIGKSFRNEITPGNFIFRTREFEQMELEFFCKPGEEIEWQNYWKTFASEWLTDLNISEDNMRLRDHDEDELSHYSNATTDIEYKFPFGWGELWGIASRTDYDLRQHSEHSGEDFKYHDPETNEKYIPYCIEPSLGADRVTLAFLCDAYAEEGVEGSKDARTVMHFHPALAPYKAAVLPLSKKLSSEAIKIFEQLSSSFAIDFDESQSIGKRYRRQDEIGTPYCITFDFDSLEDNQVTVRDRDSMEQVRMPISELETFLAEKVKF

SEQ ID NO: 3580 - protein, 355 aa, Staphylococcus epidermidis
PMNTLILLTKRGNNLNIEDFDYHLPESLIAQTPLKNRDQSRLLVLSKDTGELTHLHFRDVIHYFEPGDTLVLNDTRVMPARLFGLKEETGAKVEMLMLTQIEGNDWEVLLKPAKRIKKGHRLNFGDGKIVAECIEELEQGGRIMRLHYEGILQERLDELGEMPLPPYIKERLDDPDRYQTVYAKESGSAAAPTAGLHFTDDLLNKIKQKGVHIAFITLHVGLGTFRPVSVENIDDHEMHSEYYQMTQETADLLNKTKESGKRVISVGTTSTRTLETIRRDHPQFVATSGWTDIFIYPGFEFKAIDGLITNFHLPKSTLVMLVSAFSNKKYILNAYHKAVEMEYRFFSFGDAMLII

SEQ ID NO: 3581 - protein, 91 aa, Staphylococcus epidermidis
RGVTKMELTSLIIPILLLVVMYFLLIRPQQKRAKEHRAMINRVEAGQKITTIGGIKGTIKAVDETSVIITVNSNGTEMTFEKPAIKQVDPS

SEQ ID NO: 3582 - protein, 330 aa, Staphylococcus epidermidis
KVMTDIILAADIGGTTCKLGIFDKDLEQLHKWSIDTDTSDHTGELLLKNIYNSFTEKIAEYKYDFNNVVGVGIGVPGPVDFDTGVVYGAVNLHWPDSVNVREIFKQYVNCPVYVDNDANVAALGEKHKGAGEGADDVVAITLGTGLGGGIISNGEIVHGHNGSGAEIGHLRADFDQRFQCNCGKSGCIETVASATGVVNLVNFYYPKLTFKSSILQLIKDNQVTAKAVFDAAKAGDQFCIFITEKVANYIGYLCSIISVTSNPKYIVLGGGMSTAGLILIENIKTEYRNLTFTPAQNNTEIVQAKLGNDAGITGAAGLIKTYIIDKEGAK

SEQ ID NO: 3583 - protein, 380 aa, Staphylococcus epidermidis
HMPAVTYEHIKTCKQSGARLGIVHTPHGSFETPMFMPVGTKATVKTMSPEELRNIEAKIILGNTYHLWLQPGNDIIKHAGGLHKFMNWDGPILTDSGGFQVFSLSNLRKISEEGVEFRHHTNGSKLFLSPEKSMQIQNDLGSDIMMAFDECPPMPAEYDYVKDSIERTTRWAARCLKAHQRPGDQALFGIIQGGEYKDLREQSAKELVSLDFPGYAIGGLSVGEPKPVMYDMVEHTEQFMPKDKPRYLMGVGSPDALIECSIRGMDMFDCVLPTRIARNGTCMTSNGRLVVKNAKYADDLRPLDEQCDCYTCQHYTRAYIRHLVKAEETFGIRLTTIHNLHFLLKLMEDIRQAIREDRLLDFKDEFFEQYGLNVENPKNF

SEQ ID NO: 3584 - protein, 201 aa, Staphylococcus epidermidis
LFMAFELPNLPYAYDALEPHIDKQTMEIHHDKHHNTYVTKLNSAVEGTDLEAKSIEEIVANLDSVPSNIQTAVRNNGGGHLNHSLFWELLSPNSEEKGEVVDKIKEQWGSLDEFKKEFADKAAARFGSGWAWLVVNNGQLEIVTTPNQDNPITEGKTPILGLDVWEHAYYLKYQNKRPDYINAFWNVVNWEKVNELYNATK

SEQ ID NO: 3585 - protein, 253 aa, Staphylococcus epidermidis
VDNLQRYFMNQSADENQCFFIENKEDYHHIVNVMRYKEGQNIIVTFSDENVFKCKIISINDQSIEIKLVEKQQINTELPQNITICSGLIKADKYEWMIQKATEMGANEFIAVAMERSVVKLTDSKVEKKLSRWQKIIKEAAEQSYRLTIPNIKFKSNLKEIYGMISQYDYVLIAYEEQAKHGELSQFKQTIKQFKTQDRVLIIFGPEGGLSDSEISLFGDVSTIVGLGPRILRAETAPLYALSAVSYEKELLG

SEQ ID NO: 3586 - protein, 739 aa, Staphylococcus epidermidis
PMFYIALAFLVGVLWIKFKVISISLILTLLLLIMIKRLNIIILLLMFISAISFFFLISSYNQTEIKNINSLYNEPFIDDFVTFKSFTPKSTYYTGILNYKNKDYRYFYKILKSNFKQDLTHKSCRVKGEFKFEKELSLLNISTVQFKSCQENNIFTPIYHHQNYITKIIHISGVTHPERILALITGDTSLIDEYYKSNIKDIGIYHLLAISGTHVGTIIVLVYQLLVRLNIPLVLIKGVTILLLLIYAVYTGFVPSAMRAISIAIIILMLPIHFRKSSIHVLSFIFVLMILLNPQFINHIGFQFSFLISLFIILAKPYISALKPLKCLFIISFLAQLGSIVINTYHFNQFQWIGLLSNFIFVPFYSFILFPSVIIYFILIHFFQHSFLLNTYINMLFKIHDWLVQLFLNLNHLKWYIPKLNQYSLLILIILTLIFLYILVYRGFVTSVLSFLIVLIIFTHLIRPHYAELTLFDVGQGDSILFKTKSNKSVLIDTGGKKNENVSFKHNNIAKYKILPIIKKKGITTINYLVITHPHADHMGELIYFLNNINVNNLVLNIESFPLKLLKEVTTKCKEKKINILDVNQVKKIDIDNSKISFLNSFIPLIDDKNEHSIVTLIEYNGINILLMGDATVNNEDILMKRYNLPKIDILKVGHHGSRTSSSKLFIKDIEPKISLISSGKNNKYHLPNLDVIQRLKYYGSKVFDTQDNGELTINLDEEVYIVYRDNLNQKSLARESVS

SEQ ID NO: 3587 - protein, 243 aa, Staphylococcus epidermidis
ILSYSFLIHIRSLKMINLNQRLSIVCSFIKRGTLADIGSDHAYLPIYAIQNDLCTKAIAGEVIQGPYKAAKRNIANYELNQQVDVRLGDGLSVINSEDQIDNITVCGMGGPLIAKILNDGKDKLVNHPRLILQSNIQTQALRQTLNKLSYEIVDERIIEEKGHIYEIVVAEFNNNLVKLNILQEKFGPFLLRECNNIFQKKWQRELEALRDIKSQLNSTSHHERLKEIEDEINLIQEVLINEN

SEQ ID NO: 3588 - protein, 90 aa, Staphylococcus epidermidis
GVSYMENFDKTMKFSYEEIPKEDVKSVLQNVHRTLEERGYNAVNQIVGYLLSGDPAYIPRQNEARNQIRHIDRDVIMEELVSNYLKESKN

SEQ ID NO: 3589 - protein, 295 aa, Staphylococcus epidermidis
LRHQRTLSVRKTFVLRIFMYIIIKKHRYNELESKELKMKHQFSRNELAIGQEGLNLLKNKTVAVLGVGGVGSFAAEALARTNIGHIILIDKDDVDITNVNRQIHALTSTIGQSKVTLMEERIKLINPDCKVTSLHMFYTEETYKDIFNNYDIDYFIDASDTIIYKVHLMKECLERGIELISSMGAANKTDPTRFEIADISKTHTDPMAKVIRNRLKRLGIRKGVKVVFSDESPIVIREDVKETVGDKNAINRKGQMPPSSNAFVPSVVGLICASYVVNDILKDIPVRRIKDKGQN

SEQ ID NO: 3590 - protein, 449 aa, Staphylococcus epidermidis
ILSHRYIPLTEQDKNEMLNSIGAKSISELFDDIPTDILLKRNLNIAESEAETILLRRLNRLAAKNTTKETHATFLGAGVYDHYTPAVVDAMISRSEFYTAYTPYQPEISQGELQAIFEFQTLICELTDMDVANSSMYDGMTSFAEACILALSHTKKNKIVVSSGLHYQALQILHTYAKTRDEFEIIEVDLKGTITDLEKLEQLIDDNTAAVAVQYPNFYGSIEDLEQINNYIKDKKALFIVYANPLSLGLLTPPGTFGADIVVGDTQPFGIPTQFGGPHCGYFATTKKLMRKVPGRLVGQTQDDEGNRGFVLTLQAREQHIRRDKATSNICSNQALNALASSIAMSALGKQGIYEIAVQNLKNANYAKNKFEEHGFEVLKAQSFNEFVVKFNQPIKNINLKLAEYGYIGGFDLGEVSDDFKNHMLVAVTELRSKDEIDDFVTKAGELND

SEQ ID NO: 3591 - protein, 364 aa, Staphylococcus epidermidis
TKCLKKVLYVKKLSINTFKYKRNKYLTEIQSIDLLQRLQQLLSHGFTLYQSFKFLNSYFKYKERTINKKIIQHLQNGATCYDILKIIGYPELVLLQIKFAENYGNIEEALVDTVQYMKRNLKAKKRLIKTLQYPVALISIFLFILTILNITVIPQFQQLYETMNVKLSTFQNLLTLIITRLPKLTFIFIFISGIAFFITYKFYYYLPIEKKLKSILKIPMINTYYKIYRTYQLSNQLSLFYRNGTSLQQIVRIYRNEQDNDFLKFLGDYLFKEANKGLPLPVILMNLKCFQNDLIKFIEQGEKNGKLDIELKLYSQMLLQQFEEKVLKQTKFIQPIIFFILGIFIVSLYLVIMLPMFELMQTIK

SEQ ID NO: 3592 - protein, 593 aa, Staphylococcus epidermidis
KGSLKMNKRTTYCGLVTEEFLNEKVTLKGWVHNRRDLGGLIFVDLRDREGIVQIVFNPDFSEEALQVAETVRSEYVVEVEGVVTKRDAETINPKIKTGQVEVQVSNIEIINKSETPPFSINEENVNVDENIRLKYRYLDLRRQELAQTFKMRHQTTRSIRQYLDNNGFFDIETPVLTKSTPEGARDYLVPSRVHEGEFYALPQSPQLFKQLLMISGFDKYYQIVKCFRDEDLRADRQPEFTQVDIEMSFVDQEDIIAMGEDMLRKVVKDVKGIDVSGPFPRMTYAEAMDRFGSDKPDTRFGMELINVSQLGKEMNFKVFKDTVDNNGEIKAIVAKDAANKYTRKDMDALTEFVNIYGAKGLAWVKVVDDGLSGPIARFFEDVNVETLKQLTEAKPGDLVMFVADKPNVVAQSLGALRIKLAKELGLIDESKLNFLWVTDWPLLEYDEDAKRYVAAHHPFTSPKREDIEKLDTEPENVQANAYDIVLNGYELGGGSIRIHDGELQQKMFEVLGFTNEQAQEQFGFLLDAFKYGAPPHGGIALGLDRLVMLLTNRTNLRDTIAFPKTASATCLLTDAPGEVSDKQLQELSLRIRH

SEQ ID NO: 3593 - protein, 486 aa, Staphylococcus epidermidis
MNINKLYWKALYYWIRYLNYNVIYRDKEDDEIWLSHKRKHSIVVFRKDVTSTQEIRFDKSKIMERPEEIQQFIGYIPESYEFYYFTDKELSKENLNEEKPIKLKFKIISNEQSLNSLPINFLLLKMLINNEDKRTYLHYKRKVLTQNLVDKHMQRFTPITYTLILINIVIWLCMILYLNRFSDVKLLEVGGLVHFNVVHGEWYRLISSMSLHFNFEHILMNMLSLFIFGKIVESIIGSWRMLIIYIISGLYGNFVSLSFNTTTISVGASGAIFGLIGSIFVIMYLSKNFNKKMIGQLLIALVVLIVFSLFMSNINIMAHLGGFISGVLITLIGYYFKTQRSLFWSFLIVFLLIFIILQIRIFTISEDNIYDKLIRDEMIKGNYSEAKNVVKQTLNNNYADDETYYLSGLITATKSSQAEAVSEWERGLRKFPNSGVLNYELAIANRSLSDDKKALKYIKKAVAINPNNKKYVNLKKELSKSNDTKN

SEQ ID NO: 3594 - protein, 146 aa, Staphylococcus epidermidis
MDIKKIEEVIKLVKANDVKKFKYKDSHNEIELDFTNGASQQHSQQSSQDIQQENIKSLDEKQESISNDQQEIKSPMVGTFFLQDSKELTEPKIKVGDTVTEGDIIGYIEAMKVMNEVTTDVTGEVTEILVEHGDNVEYDQLLVRVK

SEQ ID NO: 3595 - protein, 122 aa, Staphylococcus epidermidis
LEINMKRFKYAYEGFCAILKKDQNFLLHILAAIIIIILGFVLNIDRIDWILIIVAIGLVLSFEAINTSIEFVVDLITTDYHEYAKYAKDIAAFSVVIVSIVSICIGLIVFLPYILEIFKGGM

SEQ ID NO: 3596 - protein, 185 aa, Staphylococcus epidermidis
NHYKGKGEKIVGIIKKLFMPNAYVKSIFEIDIEKLADSGVKGIITDLDNTLVGWDVKEPTKGVKSWFAKAKDLGITVTIVSNNNKSRVSSFSSNLGVDYIFKARKPMGKAFKMAIKKMKIQPRETVVVGDQMLTDVFGGNCNGLYTIMVVPVKRTDGLITKFNRLIERRLLNHFRKKGYIKWEEN

SEQ ID NO: 3597 - protein, 231 aa, Staphylococcus epidermidis
RGDKMNIGIIIFIISVIITGVSALRDKSHEDRQNQRPNQKTSNEQHQEGGFFEKLEKTFQEISDELNDEPEKKQSKPFETSLPPLNEDWNENEKKKTSHHKEKQNTSQSKRQTTSTHEHQNIPQPDKTTSRDDNYEKLKQELEQDVTKNLIDVRKEIDKEKEKQLVMIERKAQDIINDKYLSERTKRYRIKQLLNSRNVEKNMSRSAFQYDSDEVINGIIWSEILNKPKQL

SEQ ID NO: 3598 - protein, 502 aa, Staphylococcus epidermidis
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQNIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 3599 - protein, 423 aa, Staphylococcus epidermidis
YSILIGGQKMGENTKQDFNQKGQNFKFTKKHRRLLYGSVFLMATSAIGPAFLTQTAVFTAQFYASFAFAILISIIIDIGAQINIWRILVVTGLRGQEISNKVLPGLGTIISILIAFGGLAFNIGNIAGAGLGLNAMFGLDVKWGAAITAIFAILIFVSRSGQKIMDVISMILGIVMILVVAYVMVVSNPPYGDALVHTFAPEHPFKLILPIITLVGGTVGGYITFAGAHRILDSGIKGKSYLPFVNRSAVAGILTTGVMRTLLFLAVLGVVVTGVTLSSENPPASVFQHALGPIGKNIFGVVIFAAAMSSVIGSAYTSATFLKTLHKSLLNKNNLIVITFIVISTFVFLFIGKPVSLLIIAGAINGWILPITLGAILIASRKKSIVGNYQHPTWMLVFGIIAVIVTIMTGIFSLQDLASLWKG

SEQ ID NO: 3600 - protein, 897 aa, Staphylococcus epidermidis
IILNYDYLTAITKTYEGEFLFMKKMKASEIRQKYLNFFVEKGHMIEPSAPLVPIDDDSLLWINSGVATLKKYFDGRETPKKPRIVNSQKAIRTNDIENVGFTARHHTFFEMLGNFSIGDYFKHEAIEFAWEFLTSDKWMGMEPEKLYVTIHPEDTEAFRIWHEDIGLEESRIIRIEGNFWDIGEGPSGPNTEIFYDRGSAYGKDDPAEEMYPGGENERYLEVWNLVFSEFNHNKDNTYTPLPNKNIDTGMGLERMTSISQNVRTNYETDLFMPIIKEVEHVSGKKYLIDDAQDVAFKVIADHIRTISFAIADGALPANEGRGYVLRRLLRRAVRFSQSLGINEPFMYKLVDIVADIMEPYYPNVKDKSNFIKRVIKSEEERFHETLEEGLTILNELIKEAKNSDQVIKGHDAFKLYDTYGFPIELTEELATQENLSVDMPTFEQEMQQQRDRARQARQNSQSMQVQSEVLKNIQDESQFVGYETTDYQSLITHIIYNGEEVKHVEAGETIYFILRETPFYAVSGGQVADKGTVGNESFEINVTDVTKAPNGQNLHKGIVQFGEATQNAKVEARVNKEDRRLIQKNHSATHLLHAALKEVLGDHVNQAGSLVEPERLRFDFSHFGPMTQEEINLVERRVNEEIWRAIDVRIQEMSIEEAKSIGAMALFGEKYGDIVRVVNMAPFSIELCGGIHVNNTAEIGLFKIVSESGTGAGVRRIEALTGKGAFLHLEEIETQFNNIKNHLKVKSDNQVVEKVKQLQEEEKGLLKQLEQRNKEITSLKMGNIEEQVELINNLKVLATEVEIPNPKAIRSTMDDFKSKLQDTIIVLVGQVDGKVSVIATVPKSLTNQVKAGDLIKNMTPIIGGKGGGRPDMAQGGGTQPEKITEALRFIKDYIKNL

SEQ ID NO: 3601 - protein, 165 aa, Staphylococcus epidermidis
KKDKKHVNPVRQLVLQMEKQLPIKNIKAFSLVEMIFTLFIISCLLITTLWSRSLFDIQLIDEEYEIKQLITKFNYYKSKAISNNESITLLFFNNSNRVQVIEENGDKYSFKLNKGKVINIAKIQTLNFDKNGNINHFGSLILQYNSHAYRLIFHIEKGRLRFVKI

SEQ ID NO: 3602 - protein, 132 aa, Staphylococcus epidermidis
GGCKMSISLYIAIGIIVIIIAYMIIQQILNKRAVNELDQNEFHKGLRKAQVIDVREKVDYDYGHINGARNIPITVFKQRYQGLRNDQPIYLCDANGIASYRAARILRKNGYKNIYMLKGGYKKWTGKIKSKK

SEQ ID NO: 3603 - protein, 318 aa, Staphylococcus epidermidis
WISNIYKRRMTMVELLVTPKSITHMETLIDKGADAFVIGEQKFGLRLPGEFNRDAMQEAVALAHKNNKKVYAAVNGIFHNYHLDALEDYINFLHDIQVDRIIFGDPAVVMYVKQHEHPIPLNWDAETLVTNYFQCNYWGKKGANRAVLARELSLDEIIHIKEHADVEIEVQVHGMTCMFQSKRMLLGNYYTFQERQMKIERQHDHGDLLLYDEERDNKYPVFEDYNGTHIMSPNDICLIEELEPFFEAGIDAFKIDGILQSEEYINVVTEQYREAIDLFNEDPDAYEDEKFMLVDPIEEIQPEHRPFDEGFLYKQTVY

SEQ ID NO: 3604 - protein, 461 aa, Staphylococcus epidermidis
SELNRRNSMMYRCLIANRGEIAVRIIRACRELNIETVAIYAKGDENSLHVSLADQAICIGEANPLDSYLNIDRIISAAKVTESNVIHPGYGFLSESTNFAKAVEDNHIHFIGPSKTTMEMMGDKITARQTVKQAGVPVIPGSNDAVQSVDEIKLLSKEIGFPVVLKAASGGGGKGIRIVKEASHLDQALKEAKSEGQKYFNDDRVYVEAFIPVAKHVEVQIIGDGKNNYVHLGERDCSVQRKNQKLIEEAPCAALTEERRTRICGDAVKVAQASRYRSAGTIEFLVTEDAHYFIEMNARIQVEHTVTEMRADRDLLQAQLYLLTHGELPFTQKDILFNGHVIEARINAENPEKNFLPTPGKVNKLHLPQGFNIRVDSLLYTGYQVSPYYDSLVAKVIVKDSNRQTAINKLKVALDEMVIEGFTTTADFLYAVLNYPIYAKGDASKVDIKFLEKHQIIKEVK

SEQ ID NO: 3605 - protein, 115 aa, Staphylococcus epidermidis
QSIKSTHNRMITVDITVNDEGKVTDVVMDGHANHGEYGHDIVCAGASAVLFGSVNAIMGLTSEKPDINYEDDGGYFHIRSVDTNNKEAQLILQAMLVSLQTIEEEYNENIKLNYK

SEQ ID NO: 3606 - protein, 62 aa, Staphylococcus epidermidis
ITVKPFLNHTHSAWFSLYNKEASNEFIKNSFTGYFARNYIPDSLNSKFIYITIRNRVWKVLQ

SEQ ID NO: 3607 - protein, 98 aa, Staphylococcus epidermidis
DLSKYKFKGSLIIDALLAFFIVSTITMILIPMFSNLNNQYLINLNNIKIKQIMITSLQHYKKKELYQGVVIENYEIQLFNNKICGEDKAFNTRTCISI

SEQ ID NO: 3608 - protein, 339 aa, Staphylococcus epidermidis
RNRKIKRSDLMFSIGFIIIAVIIVVALLILFSFVPVGLWISALAAGVHVGIGTLVGMRLRRVSPRKVIAPLIKAHKAGLNLTTNQLESHYLAGGNVDRVVDANIAAQRADIDLPFERGAAIDLAGRDVLEAVQMSVNPKVIETPFIAGVAMNGIEVKAKARITVRANIARLVGGAGEETIIARVGEGIVSTIGSSEHHTEVLENPDNISKTVLSKGLDSGTAFEILSIDIADVDISKNIGADLQTEQALADKNIAQAKAEERRAMAVASEQEMKARVQEMRAKVVEAESEVPLAMAEALRSGNIGVKDYYNLKNIEADTGMRNAINKRTDQNDDESPQQ

SEQ ID NO: 3609 - protein, 230 aa, Staphylococcus epidermidis
SCRNEGEKMHEQSKIYQNIKDGKLDTALKDLFENIEENPAIVENYINAGIVLSDVGEIEKAERFFQKALTIEPENGAVYYNLANIYYNEERYNEAIKLYQTALQYEVAKKDCNYMIGMSFNQLGAFKEALPFLMTAAEMDDDRDLEVQFQYGLVLCQLEMFDEAIKQLNKVLSIDSQHVDGIYNLGLATYMKNENLDEAIAYFEQAISIDEKHLLSQHALKTFKTMKEEE

SEQ ID NO: 3610 - protein, 172 aa, Staphylococcus epidermidis
INLKSIQVPIILVGFMGTGKTTVGKYLSDLYNLSYVDLDNFIEVNECKSIPNIFNDIGEKGFRSLETRYLKSCLNTFDIISTGGGIIEDTNSLKLLKNQKHVVWLDCDIEIIFKRVKNDSHRPNAKSKNLNQLDALYSSRLSRYNEIAFMKVDSAQSVSEICTLIKTKLLSD

SEQ ID NO: 3611 - protein, 165 aa, Staphylococcus epidermidis
KIMKYNYSIIKYVGRIKHLIREHVFQFNIKAFTYIEALFALFVTTLILALLPTILKLTSFYLNTAQNNEDIQFEFFRRDLLKEKMTTQNNYEIENAYTIKLKKDKDVIRYIYKNRKIYKNINQKGNITLLNHVLSTRILKTNDNIVKLLITTGETNDEHKEILFI

SEQ ID NO: 3612 - protein, 91 aa, Staphylococcus epidermidis
KGVKNVSTEPLASRMRPKNIDEIISQQHLFGPKGIIRRMVDTIRLSSMISYGPPGIGITSIAKAISGSTQSKFRQLNAGPNTKKDMHLIVD

SEQ ID NO: 3613 - protein, 69 aa, Staphylococcus epidermidis
QQEKRTMNTKKSCLYSRKAFISLYLIVIFSIYLSIISFYISQYSLKLKTIHNLDVYYNKVIVNKLKEVD

SEQ ID NO: 3614 - protein, 815 aa, Staphylococcus epidermidis
KRRNNMSDPTLFDYSMIKGTVDAILFQNTDNFYTVLKVDTIESNEKFDSMPTVVGFLPNVVEGDVYTFKGQVVQHPRYGKQLKAETFEKELPQTKEAIISYLSSDLFKGIGKKTAQNIVNTLGENAINDILTRPEILESVPSLPKKKQKQIADQINANQESEKIMIRLHDLGFGPKLSMAIYQFYMGDTLNVLDKNPYQLVYDIKGIGFNKADQLARNVGIEPHSPERLKAALLFTLEEECIKQGHTYLPRTIVIETTQNLLNEDIEKPIETEQLLEIIDVLSEEKKLISEADQVSIPSLYYSELKSVQNLYRIKTNTSKLKEIEQSDLQIHIGDIESQNEVNYSASQKEALETAINSKIMLLTGGPGTGKTTVIKGIVELYAEIHGLSLDYDDYNEDDYPVVLAAPTGRASKRLHESTGLEAMTIHRLIGWNQDTQPQDILENEINARLIIIDEMSMVDTWLFHQFLSAVPLEAQIVFVGDEDQLPSVGPGQVFKDLIDSEIIPRVNLTEVYRQQDGSSIIDLAHRMKLNEPIDITKRYHDRSFIRCGTNQIPDVVDKVVKSAVAKGYDMSDIQVLAPMYKGNAGIKRLNQVLQSILNPKQQDDREIEFGEAVFRKGDKVLQLVNRPNDNIFNGDIGIIVGIFWAKENALNKDVLVVDFEGNEITFTKQDLMELTHAYCTSIHKSQGSEFPIVIMPIVRQYYRMLQRPILYTGLTRAKQSLVLLGEQEAFDIGLKTNGQIRLTQLNDLLKSYFGQNKDNLTTNKQTINEQKENNNHLDLKNEKENDIQLNESTIFQIDPMINMGEMTPYDFVER

SEQ ID NO: 3615 - protein, 62 aa, Staphylococcus epidermidis
LSLEGSINITFSSFSMKYVLVSTIPNVKFEIRIIIHHYGLDVFVLILIYHSFFLIYLDDHQF

SEQ ID NO: 3616 - protein, 89 aa, Staphylococcus epidermidis
EKNLVTITEVLFINYRPLVVFIKIYAFLCLIFTNLRYIYSISISRFRKILTRFTLTILFNCRVSRENNLIIKTFLKAYSLLLINLLVMI

SEQ ID NO: 3617 - protein, 204 aa, Staphylococcus epidermidis
RSTDMYAYIKGTLSQLFPTHVVVETCGIGYEIQTPNSYRFQKYLEKEVQIYTSLIVREDAQLLYGFINEEEKEMFLSLIKVTGIGPKSALAILASSTPHEVKLAIENENDAYLTQFPGIGKKTARQIVLDLKGKVTITEENSDDLLQTQVNGNEQNQIISEALLALQALGYSKRELTKVEKSLNKHNVNSVDEAVKIGLQTLVS

SEQ ID NO: 3618 - protein, 216 aa, Staphylococcus epidermidis
QHDEKGNWLMNQTTIIGIAGGSGSGKTTVTNAIMKNLEGHSVALLAQDYYYKDQSHLTFEERLETNYDHPFAFDNDLLIHNLKDLRNGKPVEVPTYDYSQHTRSKETIAFDPKDVIIVEGIFALENNTLRDMMDVKIYVDTDADLRILRRLTRDTKERGRTMESVINQYLNVVRPMHEQFIEPTKKHADIIIPEGGSNKVAIDIMTTKIQSLVSKK

SEQ ID NO: 3619 - protein, 259 aa, Staphylococcus epidermidis
KVGDQLMLMTQKGIIIKSVDYGESDKIITILNEYGAKIPIMARRAKKVKSGLQANTQLFVYGLFIYNKWRGMGTLNSVDVINQHYELQLDLFESSYASLCAETIDRSMEENEVSKYNYDLLQFVLSKINEGTPAQLMSVIVLLKNMSKFGFTASFDHCAITGIQDQSKLIAYSFKFDGAISESALYQDQHAFHLSNRTLYLLNILQQLPISKMNHLNIQQDILNEMSELLIMLYREYAGMFFKSQKLINQLNRLEKDSL

SEQ ID NO: 3620 - protein, 241 aa, Staphylococcus epidermidis
GRGEKMDNLHLIHMLFMAKPLNGMNWVENLAQFITQPFVSLIFTCIIFIGFLYQLYSKRINLMGIIALLALLLLFLAFLINGDVNVMSVLLFTIGLILLIVELFVIGAVIGIIGIILITLSIIILGDNILLMLGNVIVALILSIVEWVILVKIFNRKIPFLDKVILKDSTNSEAGYRSHDDRSHLVGKTAHTVTDLRPAGIITCDNDRIDAVSDGSFILRNRQVKILEVEGTRVVVREIEK

SEQ ID NO: 3621 - protein, 209 aa, Staphylococcus epidermidis
RPIELSQRQEQIIEIVKSEGPITGEHIAEKINLTRATLRPDLAILTMSGFIEARPRVGYFYSGKSKNKIINEKLRKYVVKDYMSHPVVIKENMTVYDAICTIFLEDVSTLFITNENNDFVGVCSRKDLLRASMIGEDIHTMPISVNMTRMPHVSYLKEQELVIYAANQMIDKEIDSLPIVRPKENDKFEVIGRISKTTITKLFVSLFKE

SEQ ID NO: 3622 - protein, 355 aa, Staphylococcus epidermidis
LLIDYQYLLKSGGLFMSDNQVKIKKQTIDPTLTLEDVKKQLIDKGKKEGHLSHEEIAEKLQNFEMDSDQMDDFFDQLNDNDITLVNEKDSSDTDDKINPNDLSAPPGVKINDPVRMYLKEIGRVNLLSAQEEIELAKRIEQGDEIAKSRLAEANLRLVVSIAKRYVGRGMLFLDLIQEGNMGLIKAVEKFDFSKGFKFSTYATWWIRQAITRAIADQARTIRIPVHMVETINKLIRVQRQLLQDLGRDPAPEEIGEEMDLPPEKVREILKIAQEPVSLETPIGEEDDSHLGDFIEDQEAQSPSDHAAYELLKEQLEDVLDTLTDREENVLRLRFGLDDGRTRTLEEVGKVFGVTT

SEQ ID NO: 3623 - protein, 283 aa, Staphylococcus epidermidis
LLIDALLNFDFIRYSLISGLLIGFIAPLIGAFIVVRRLSLIADALSHVTLGGISFGMFLLTIIPVFSVINPMWFGILFAVIGALLIEKLRTSFSNYQEIAIPIIMSAGIALSAIFISLADGFNQEIVGLLFGSISAVNISDLTTIIIITIIVLIFIVLFYKELFILSFDEEYSKVIGIPKWIQFLFIVIVAMVISASMRVVGILLVSALITLPIAISMRITKGFKQLIALSVILGELSVILGLIIAFYMNISPGGVIVVLLVLMLILTMIIQKLKIKFKKGVV

SEQ ID NO: 3624 - protein, 117 aa, Staphylococcus epidermidis
MNSEELLNIAVEAAENKKAEDIISLNMNEISDMTDYFVVCHGNNERQVQSIARSVKEVAHKHDIDVKRMEGYQEARWILIDLANVVVHVFHKDERSYYNLEKLYQDAPIKEYGQAVF

SEQ ID NO: 3625 - protein, 387 aa, Staphylococcus epidermidis
FDKECPNMEVYADYAATTPVKPEVIDAMMEIYQSHFGNPSSIHSIGRDARKYLDQSRRTVAQLLGANPNEVIFTSGATESNNTAIKGLVKANEQLGNHIITTKIEHHSVLHVYEQLEKEGYDVTYLDVDDTGAVDLDQLKETINDRTILVSIMFVNNEIGTVQNIYDIEDIIGDTHALFHVDAVQAIGHLDLDFHNFKIDTMSISAHKFGGPKGVGLLLVKEHTPIAYNQLGGEQETKRRAGTENLPQIVGLTKALELAITNQDVNNVHLMNLKELFLVQLQERAIPFELNGSMTDSTGHILNIYFPFIDVETMLTLLDLAHVYVSSGSACTAGSTTPSHVLAAMFEDEERAKHSVRFSFNEQTTTQEIKYIVAEIHKIYHKFKEES

SEQ ID NO: 3626 - protein, 331 aa, Staphylococcus epidermidis
YIEEGVRMSNNIFTVYGEVPELVEKKTKEIVNDYLGQEIDDFNYVKYNLYESDLTPIIEETLTMPFFSNKKAIVVKNSYVFTGEKFSKDLNHNSDELIKFLEKYDGENLIIFEVYQPKLDERKKLTKTLKKNAQLKKIEQMSEKELKHWIKNTLNNNYKDIKQDALELFIELTGVNYNIVSQELEKLILFIGERPIINKEDIDLIINRSLEQNVFLLTEYIQKGNKNKAIQLVNDLIIMKEEPIKLLALITSNYRLYYQCKILSQKGYSGQQIAKTVNAHPYRVKLALNQSRHYKLESLFNIINACAETDYKLKSSYMDKQLILELFILSL

SEQ ID NO: 3627 - protein, 390 aa, Staphylococcus epidermidis
LFHCLLPKPKTIIIITSYAIILMYKIKMYKCKRRREKMNKLRKVLDIIEHKHLDAIIVLSDYNRRYLSDLTGTSGALIITPKKQYLITDFRYIDQATEQAQDFEIINRKSSLISEIKSILERENLSNIGFEGHLISYDTYVELNKGLITLISISNEIDKIREIKNKEEIQLIQKAAKIVDQTYEYILTQVSIGMTEREIKAKLESKMLELGADGPSFDTIVASGYRGALPHGVASDKRIEKGDMITLDFGAYYRGYCSDITRTFAIGEPDPKLKEIFNIVLTSQKKAIEQIKPGMTAKEADAISREYISSHNYGEQFGHSLGHGIGLDIHEGPLLSQNSSDELKINNCVTIEPGIYIEGLGGVRIEDDILITENGCHVFTKCSKDLIILE

SEQ ID NO: 3628 - protein, 313 aa, Staphylococcus epidermidis
SMNWMELSIVVNHEVEYDVTEILESYGSNGVVIEDSNILEEQPVDKFGEIYDLNPEDYPEKGVRLKAYFNEFTYNENLKSNINYEILSLQQIDKTIYDYQEKLIAEVDWENEWKNYFHPFRASKQFTIVPSWESYVKENDNELCIELDPGMAFGTGDHPTTSMCLKAIETFVKPTDSVIDVGTGSGILSIASHLLGVQRIKALDIDEMAVNVAKENFKKNHCDDAIEAVPGNLLKNENEKFNIVIANILAHIIEEMIEDTYNTLIEDGYFITSGIIEEKYQDIESQMKRIGFKIISVEHDNGWVCIVGQKVSG

SEQ ID NO: 3629 - protein, 211 aa, Staphylococcus epidermidis
IHYWLLYCIKKTMRYAYGSEKVLPLSKKTSHHARIYIGQPTKIFNTRRCFFMSSDTNSLAHTKWNCKYHIVFVPKYRRQVIYGKIKRDIGVILRQLCERKGVEIIEAEASKDHIHMLVSIPPKLGVSSFVGYLKGKSSLMIFDRHANLKYRYGNRKFWCKGFYVDTVGRNKKVIENYIRNQLQEDIVADQISMEEYLDPFTGEEIKKRRKK

SEQ ID NO: 3630 - protein, 123 aa, Staphylococcus epidermidis
NGSCIYFTRLFRFYSIKEKLKMTEHNHDAELTINNEEELLTLYDENGNEVLYRKMLEFYHPEFKKEYVVLAEEGAQSDDEDMIELVPMINEPDESGDGGKLVPIETDEEWDMIEEVVNTEINE

SEQ ID NO: 3631 - protein, 298 aa, Staphylococcus epidermidis
IAGWENNMKKIDSWLTKHGLKNRLTLVVIVIFIIFLILLFMFVNLSDEDTGQITITENAELRTGPNAAYPVIYKIEKGKSFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 3632 - protein, 698 aa, Staphylococcus epidermidis
VVLLKRLKEKSNDEKMRNTMNKRINFIFGFIVFIFAIVVLRLGYLQIAQGSHYKQLIKNDENITVNESVPRGRILDRNGKVLVDNASKMSITYTRNRKTSQKEMLNTAKKLTDLIKMDTDKITERDKKDFWIQMYPSFAKKLMRKEQLMLEDGSISQDQFDTQLRDKIGKKQLKQLTKKDLQVLAIYREMNAGSTLDPQTIKNEDVSEKEYAAVSQQLSKLPGVNTTMDWDRKYPYGDTLRGIFGDVSTSTEGIPKELTEQYLSKGYSRNDRVGKSYLEYQYEDVLKGTKKQMKYTTDKSGRVISSEVLNPGSRGHDLQLTIDIDLQKKVESLLEKQISKLRSQGAKDMDNALMVVQNPKNGDILAIAGKQIDKQGKLKDYDIGNFTAQYTVGSSVKGGTLLAGYQNKAINVGETMVDEPLKFQGGLTKRSYFNKNGHVSIDDKQALMHSSNVYMFKTALKLAGDPYTSGMSLPNNIADAGRKLRKGLNQVGLGLKTGIDLPNETPGQIEPLTNNPGNYLDLAIGQYDTYTPLQLSQYVSTIANDGYRIQPHIGLSIYESTNKDETGPLKRKIKGNVLNKVNNSNDEIKEVQEGFKMAFNEKQGTGYASFRNTVVPSAGKTGTAEVFQDGEPRVNSTYIGYAPVDDPKLSFSIVYTNQPVPPPWLNGGDLGRDVINYYFKDKDNKKDDSQSNNEEKED

SEQ ID NO: 3633 - protein, 145 aa, Staphylococcus epidermidis
KGSRLRMNTNDAIKVLKENGLKYTDKRKDMLDIFVKEDKYLNAKHIQQQMDKDYPGISFDTVYRNLHLFKDLGIIESTELDGEMKFRIACTNHHHHHFICENCGETKVIDFCPIEKIKSQLPNVNIHTHKLEVYGICEECQRKAN

SEQ ID NO: 3634 - protein, 438 aa, Staphylococcus epidermidis
KTILIFFNNKGESFMIKMPRGTQDILPQDSAKWRYIENRLHTLMELYNYKEIRTPIFESTELFARGVGDSTDVVQKEMYTFKDKGDRSLTLRPEGTAAVVRSYIEHKMQGEPNQPIKLYYNGPMFRYERKQKGRYRQFNQFGVEAIGAENPSIDAEILAMVMHIYESFGLKHLKLVINSIGDSESRKEYNEALVKHFEPVIDTFCSDCQSRLHTNPMRILDCKIDRDKEAVKNAPRITDYLNNDSKSYYEQVKLHLDNLNISYVEDPNLVRGLDYYTHTAFELMIDNPEYDGAITTLCGGGRYNGLLQLLDGPDETGIGFALSIERLLMALDEEGISLDVSEDFDLFVVTMGEDADRYAVKLINDLRRNGIKVDKDYLNRKIKGQMKQADRLNAKYTVVIGDQELENNEIGVKNMISGESENVQLDELVNYFKSRKEV

SEQ ID NO: 3635 - protein, 154 aa, Staphylococcus epidermidis
LMERIKWEEYFMAQSHLLALRSTCKRLSVGATIVKDNRIIAGGYNGSVAGEVHCIDEGCLIEDGHCIRTIHAEMNALLQCAKQGVSTEGATIYVTHFPCLNCTKSIIQAGIKTIYYAQDYHNNDYAIKLLKQSGIEYKKIPFSPEYVAQYLTQE

SEQ ID NO: 3636 - protein, 600 aa, Staphylococcus epidermidis
CLLRIDQSVIDEIKNKTDILDLVSEYVKLEKRGRNYIGLCPFHDEKTPSFTVSEDKQICHCFGCKKGGNVFQFTQEIKDVSFVEAVKDLGERVNIQVDIGQNQTNSSTKIASDELKMIEMHELIKDYYHYALMKTVEGEEALNYLHERGFTDDLIKEREIGYAPDNSHFCHDFLEKKGYDIELAFEAGLLSRNEENFTYFDRFRNRIMFPLKNGQGRIVGYSGRTYTDQEPKYLNSPETPIFQKRRILYNLNKARKFIRKQDEIILLEGFMDVIKSDYAGLKQVVASMGTQLSQEHITFLQKLTQNVTLMFDGDYAGKEATLKTGQALLNQGLNVYVVQLPSGMDPDDYIRKYDNEQFLKFVQQDKQSFVLFKVKMYQNEINHNDLAYEKHFKETVRDLSLVNSGIIRNKLIQNIADIFKVNPETIQYELDATYQHQMSSNTYPTFQDEPSKQQLILGRLTKNEKAERALIKHLTKDKDTFLNYYQKIVPEDFTNSYLKRIFSYLYDYYSKNDYYTISDMMQYIESNELREVLIELDQYHLNDEPYENEIEDYIQIIKNNNNEDSLESLNYKLREASRIGDSELQKYYLQLIVNKNKNRM

SEQ ID NO: 3637 - protein, 209 aa, Staphylococcus epidermidis
IIMRISNLTLGIVDTNTYFIENEENVILIDPSSESQKIIKKLNQINKPLKAILLTHAHYDHIGALDNIIEKYQVPVYMSKDEFDFLTDPDKNGSSKFTQYGLSKIESHANPLSLSEGPAEIEGFKFKVLHTPGHSPGSLSFVFNDFAVVGDTLFKNGIGRTDLYKGDYETLIDSIKDKLFELEGDMPLFPGHGPYTTVDDEQLNPFING

SEQ ID NO: 3638 - protein, 283 aa, Staphylococcus epidermidis
YFDRGMIMTEIWNFINTGSKNPYYNMAMDEALLNFVSRGEIDPVIRFYTWNPATLSIGYFQRLQKEIDIDKVKEKGYGLVRRQTGGRGVLHDKELTYSVIVPESHPNMPSTVTEAYKIISQGLLEGFKNLGFETYFAIPRSKEERDKLKQPRSSVCFDAPSWYELVVEGRKIAGSAQTRQKGVILQHGSILQDIDIDDLFDMFKFKNERLKAKMKENFVQKAVAINDISNQHITLNEMENAFEAGFKKGLNIDFKPLELTEKQLEEVQELEDKYRSEAWMYRK

SEQ ID NO: 3639 - protein, 118 aa, Staphylococcus epidermidis
SRTRYKSNEKHSNSKIERSIMMLTGKQKRYLRSLAHNIDPTFQIGKGGINENMIQQISETLEKRELIKIHILQNNFDDKKDLAAIVSQQTQSELVQIIGSMIVLYKESEENKEIKLPQ

SEQ ID NO: 3640 - protein, 148 aa, Staphylococcus epidermidis
KSLRINMLKHKILGLDVGSKTVGIAISDLMGWTAQGLDTLRINEEQDDLGIDQLVKIIKDNQVGTVVIGLPKNMNNSIGFRGEASIKYKEKLQESIPSIDIVMWDERLSTMAAERSLLEADVSRQKRKKVIDKMAAVFILQGYLDSIQ

SEQ ID NO: 3641 - protein, 273 aa, Staphylococcus epidermidis
KLISCIVICEVKTMTTPVFELRNLDYYFDNKHVLENINIKINQGEFLAIVGPNGAGKSTLLKVILGLLPIQKGEIIVDGKPFKGNKSSLKISYVSQKASAFNAGFPASVKEVVLSGLTKTKKLFQRFNKNDYQKVTKVLERLNISHLINKNIAELSGGQQQRVLIARALISDPSVLVLDEPTNGIDAKHVSKFYDTLDKLKKQGITIILVTHDIGVVADTATEVACLNKHLHFHGSTEAFKSLDEVEISKIYGHPIQFVDHQHNRTCCNEGNE

SEQ ID NO: 3642 - protein, 106 aa, Staphylococcus epidermidis
EVQSMFAIIETGGKQIKVEEGQEIYVEKLNANEGDSFTFDKVLFVGGDSVKVGAPTVEGASVTATVNKQGRGKKITVFTYKRRKDSKRKKGHRQPYTKLTIDKINA

SEQ ID NO: 3643 - protein, 233 aa, Staphylococcus epidermidis
GVKRYMIGIIGAMEEEVTILKRKLNDMNEINIAHVKFYVGKLNHKEVVLTQSGIGKVNASISTTLLIEKFNPEVVINTGSAGALDQTLSIGDILVSNHVLYHDANATAFGYEYGQIPQMPKTYTTDPTLLKKTMHVLEQQQLNGKVGMIVSGDSFIGSSEQRQKIKQQFPEAMAVEMEATAIAQTCYQFKVPFIVTRAVSDLANGKADISFEEFLDKAALSSSETVSLLVESL

SEQ ID NO: 3644 - protein, 359 aa, Staphylococcus epidermidis
NNLSNSILKIKNDCYTSIIINYGKEASCMKNIKLSALNLVPIREGQEDKDAINDMVTLAQALDDLDYERYWIAEHHNAPNLVSSATSLLIQHTLEHTHSIKVGSGGIMLPNHAPLVVAEQFGTLETLFPQRVDLGLGRAPGTDMMTASALRRDQHNGVYQFPEEVEQLQQYFGPSHQQAYVRAYPAVDKNVPMYILGSSTDSAHLAARKGLPYVFAGHFAPQQMKEALQIYRELFEPSEVLDKPYVIVCLNTIVSDSDEQAEYLATTMSQIMVSITRGKMQPVQPPTDDLKALLTPREYELAQQRLKGSLIGSEDTVKQKLESFIKEYGDIDELMAISYIYDQDKQIESYRRLERAIKS

SEQ ID NO: 3645 - protein, 163 aa, Staphylococcus epidermidis
RKMRFMENQKQYPMTQEGYEKLEQELEELKTVKRPEVVEKIKVARSFGDLSENSEYDAAKDEQGFIEQDIQRIEHMIRNALIIEDNGDNNVVQIGKTVTFIELPGDEEESYQIVGSAEADAFKGKISNESPMAKALIGKGLNDQVRVPLPNGGEMNVKIVEIK

SEQ ID NO: 3646 - protein, 616 aa, Staphylococcus epidermidis
LNWRNYIMGKVIGIDLGTTNSCVSILEGDEPKVIQNPEGARTTPSVVAFKNGETQVGEVAKRQAITNPNTVQSIKRHMGTDYKVDIEGKSYTPQELSAMILQNLKSTAENYLGDTVDKAVITVPAYFNDGERQATKDAGKIAGLEVERIINEPTAAALAYGLDKTETDQKVLVFDLGGGTFDVSILELGDGVFEVLSTAGDNKLGGDDFDQVIIDYLVSEFKKENGVDLSQDKMALQRLKDAAEKAKKDLSGVSQTQISLPFISAGENGPLHLEISLTRSKFEELADSLIKKTMEPTRQALKDAGLSTSEIDEVILVGGSTRIPAVQEAVKKEIGKEPHKGVNPDEVVAMGAAIQAGVITGDVKDVVLLDVTPLSLGIEIMGGRMNTLIERNTTIPTSKSQVYSTAADNQPAVDIHVLQGERPMASDNKTLGRFQLTDIPPAPRGVPQIEVTFDIDKNGIVNVTAKDLGTNKEQNITIQSSSSLSDEEIDRMVKDAEENAEADKKRREEVDLRNEADSLVFQVEKTVKDLGENISDEDKKNAEEKKDALKTALEGEDIDDIKAKKEELEKVIQELSAKVYEQAQQAQQQGQEEQGSQDSTVEDADFKEVKDDEDKK

SEQ ID NO: 3647 - protein, 78 aa, Staphylococcus epidermidis
INRSFEMRKFIFYLILAIAAFGLMMNLDEFLFSIMKAIISFAIIALIIYIIYYFFFLTEDQRKYKKALRKYKRQKRKQ

SEQ ID NO: 3648 - protein, 224 aa, Staphylococcus epidermidis
TVYGSNWNCIGGQTMSEKDQSVNNTEEDFNVETEDNQNDTNIENSVSNTDNSEANASDSENNSEESIKDEESESQDTKIKELEKLANDNEEKYLRLYAEFENYKRRIQKENQINATYKAQGVLTDILPSIDNIERALQIEGDDESFKSLQKGVQMVHESLLRALKDNGLEEILAEGKEFDPNLHQAVVQDDNPDFKSGEVTQELQKGYKLKDRVLRPSMVKVNQ

SEQ ID NO: 3649 - protein, 232 aa, Staphylococcus epidermidis
SIHGLIYFVFVIVNDKGSFNDMDSNQKYLAQLHQSIDTEIEELRVYAEENQVPIVDKLTLDLIRQLIRMNRTKNILEIGTAIGYSSMQFANISKDINVTTIERNEDMIHLAKKFIKKYRYQNQIRLIEYDALNAFEQVNDKQYDMIFIDAAKAQSMKFFQLYTPLLKKGGIVVTDNVLYHGFVSNIDVVRSRNVKQMVKKVQQYNEWLMEQSQFTTNFINMDDGLAISIKGE

SEQ ID NO: 3650 - protein, 341 aa, Staphylococcus epidermidis
FLNGGSQMDKRMVDQEFHNEDTDLELSLRPTHLKQYIGQSSIKSNLEVFIKAAKLRQEPLDHVLLFGPPGLGKTTLSNIIANEMEVNIRTISGPSLERPGDLAAILSGLQPGDVLFIDEIHRLSSVVEEVLYPAMEDFFLDIIIGKGDEARSIRIDLPPFTLVGATTRAGSLTGPLRDRFGVHLRLEYYNENDLKEIITRTAEVLGTDIDKESALELARRSRGTPRIANRLLKRVRDFQQVNEDDQIYIETTKRALQLLQVDQHGLDYIDHKMMNCIINQYNGGPVGLDTIAVSIGEERVTIEDVYEPFLIQRGFLERTPRGRKATALAYEHFNTTNEKRE

SEQ ID NO: 3651 - protein, 278 aa, Staphylococcus epidermidis
RIGGKYMDNIKIIVASDSIGETAELVARAGVSQFNPKQCKHEFLRYPYIESFENVDEVIQVAKDTNAIIVYTLIKPEIKKYMISKVNEHALKSVDIMGPLMELLSNSIEETPYYEPGMVHRLDDAYFKKIDAIEFAVKYDDGKDPKGLPKADIVLLGISRTSKTPLSQYLAHKSYKVMNIPIVPEVTPPDGLFIVDPSKCIALKISEEKLNRIRKERLKQLGLGDKARYATEARIQEELDYFEKLVDKIGCPVIDVSDKAIEETANDIIHFIEQNKSK

SEQ ID NO: 3652 - protein, 296 aa, Staphylococcus epidermidis
MLIGSHVSMSGKKMLQGSAEEAHKYGESTFMIYTGAPQNTRRKNIEDLNIEKGQQAMKTYGLSNIVVHAPYIINIANTTKPEVFNLGVDFLQKEIERTQALGAKDIVLHPGAHVGAGVDKGIQKIIEGLNEVLTHDNNVRIALETMAGKGTEVGRSFEEIAQIIDGVTHNDRLSVCFDTCHTHDAGYNVKEDFDGVLEKFDSIIGVDRIKVVHVNDSKNLRGAQKDRHENIGFGHIGFDALNYVVHHDTFKNIPKILETPYVGEDKKNKKPPYKLEIDMLKSQKFDPELKNKILTQ

SEQ ID NO: 3653 - protein, 455 aa, Staphylococcus epidermidis
TFKGEQIMSKHPFEHFNLDENLIEAVKNLNFEKPTEIQNRIIPRILKGTNLIGQSQTGTGKSHAFLLPLIQLIESDIQEPQAIVVAPTRELAQQLYQVAMHLVKFKKGINVKLFIGGTDLEKDKQRCSHQPQLIIGTPTRINDLAHSGYLHAHLASYLIIDEADLMIDLGLIEDVDHIAARLDDENAHLAVFSATIPKSLQPFLNKYLSQPEFVEVDGKAHNKENIEFYLIPTKGSAKVDKTLELIDILNPYLCIIFCNSRENADELADTLNKEGIKIGMIHGGLTPRERKQQMKRIRNLDFQFVIASDLASRGIDIEGVSHVINFDVPNDIDFFTHRVGRTGRGNYKGVAITLYSPDEESNITLIEDRGYKFENVDIKNGELKPIKAYNMRKSRQRKDDHLTNEVKHKVRSKSKRKVKPGYKKKFKQEVEKMKRQERKQYSKKQNRQKRKNNKG

SEQ ID NO: 3654 - protein, 178 aa, Staphylococcus epidermidis
LSGGKTMDLKQYVSEVKDWPSAGVSFKDITTIMDNGEAYGYATDQIVEYAKEKNIDIVVGPEARGFIIGCPVAYSMGIGFAPVRKEGKLPREVIRYEYNLEYGTNVLTMHKDAIKPGQRVLITDDLLATGGTIEAAIKLVEQLGGIVVGIAFIIELKYLNGIDKIKDYDVMSLISYDE

SEQ ID NO: 3655 - protein, 736 aa, Staphylococcus epidermidis
IEWGVIKVNNEYPYSADEVLYKAKSYLSTSEYEYVLKSYHIAYEAHKGQFRKNGLPYIMHPIQVAGILTEMRLDGPTIVAGFLHDVIEDTSYTFEDVKDMFNEEIARIVDGVTKLKKVKYRSKEEQQAENHRKLFIAIAKDVRVILVKLADRLHNMRTLKAMPREKQVRISKETLEIYAPLAHRLGINTIKWELEDTALRYIDSVQYFRIVNLMKKKRSEREAYITNAINKIKNEMTKMNLSGEINGRPKHIYSIYRKMIKQKKQFDQIFDLLAIRIIVNSINDCYATLGLVHTLWKPMPGRFKDYIAMPKQNMYQSLHTTVVGPNGDPLEIQIRTHEMHEIAEHGVAAHWAYKEGKTVNQKTQDFQNKLNWLKELAETDHTSADAQEFMESLKYDLQSDKVYAFTPASDVIELPYGAVPIDFAYAIHSEVGNKMIGAKVNGKIVPIDYVLQTGDIIEIRTSKHSYGPSRDWLKIVKSSSAKSKIKSFFKKQDRFSNIEKGKFMVEAEIKEQGFRVEDILTEKNLEVVNEKYHFANDEDLYAAVGFGGVTSIQIVNKLTERQRILDKQKALNEAQEVTKSVPIKKDITTDSGVYVEGLENVLIKLSKCCNPIPGDDIVGYITKGHGIKVHRTDCPNIKNETDRLISVEWVKSKDSTQQYQVDLEVTAYDRNGLLNEVLQAVNSTAGSLIKVSGRSDIDKNAVINISVMVKNVNDVYRVVEKIKQLGDVYTVSRVWN

SEQ ID NO: 3656 - protein, 68 aa, Staphylococcus epidermidis
HVFIYFSTRGSTQISVNTRFYKNLIICQNIFVKLTPSLTRLLIILIEIIFNSKCLYVFVAIENKSYNE

SEQ ID NO: 3657 - protein, 166 aa, Staphylococcus epidermidis
VTFIQYLEFGTRGAKDMKIIVQRVKNARVTNDTIDNQINKGYCLLVGVGQNSTEEDVKVIARKIAHARLFEDENDKLNLNIQQVEGEILSVSQFTIYADVKKGNRPGFSNSKAPEQAKDLYQKFNKELEGYGLIVKTGEFGTHMNVEINNDGPVTLIYESQDGKII

SEQ ID NO: 3658 - protein, 154 aa, Staphylococcus epidermidis
NSIIRSKFFDFFDQLKSNTKGYASFDYEFIENKESNLVKMDILLNGDKVDALSFIVHRDFAYERGKALVEKLKTLIPRQQFEVPVQAAIGQKIVARTNIKSMGKNVLSKCYGGDISRKRKLLEKQKAGKAKMKAVGNVEIPQDAFLAVLKMDDE

SEQ ID NO: 3659 - protein, 456 aa, Staphylococcus epidermidis
KRIIGVKIMSTVAFHTLGCKVNHYETEAIWQLFKDANYERVEFETNADVFVINTCTVTNTGDKKSRQIIRRAIRQNPDAVVCVTGCYAQTSSAEIMEIPGVDIVVGTQDRHKLLDYIQQFQDERQPINGVGNIMKNRTYEELEVPYFTDRTRASLKIQEGCNNFCTFCIIPWARGLMRSRDPEKVVEQATQLVNSGYKEIVLTGIHTGGYGQDLKNYNLAQLLRDLDTIEGLERIRISSIEASQLTDEVIDVIGNSNKVVRHLHIPLQSGSDDVLKRMRRKYTMAHFSERLTKLHQALPDLAVTSDVIVGFPGESEDEFQETYDFIVNHHFSELHVFPYSPRIGTPAARMDNQIDEETKNVRVHKLISLSNQLAKEYASKFEDEVLEVIPEEMGEEPHTLVGYADNYMKVRFEGDDSLIGQIVKVKIVKANYPINEGKAIRVVKHATNQSEKEVLV

SEQ ID NO: 3660 - protein, 155 aa, Staphylococcus epidermidis
MFTIDFSDHTGLVETSWFDQIDQLLTFAKKKENIHNDAELSVTFVDKDEIQNINKVYRDKDKVTDVISFALEEDEPEIDFNDFDIPRVLGDIIICTDVAKEQSESYGHSFERELGFLALHGFLHLLGYDHMNDNDEKEMFGRQDAILNEFGLTRN

SEQ ID NO: 3661 - protein, 79 aa, Staphylococcus epidermidis
CKTIQGTIHRVATLFDYTDKSIIHSKRLTCAIRLLIKSTSSCVQIFKLLSTILQPRIVFLRIKCYLLHLKFQESYRFYL

SEQ ID NO: 3662 - protein, 328 aa, Staphylococcus epidermidis
EVIFLKILFEQIINHAIKQEASDIHFIPCEEHTIIKLRIKDELTIYDRLSFPIYKKLLIYMKFQSGLDVSTQHRAQSGRYSYKMKHLYYLRISTLPLSLGNESCVIRIVPQYFQTTRESYEFKDFKHFMKKKQGLLLFSGPTGSGKSTLMYQMVLYAHQKLNLNVISVEDPVEQILNGITQISVNEKAGINYESSFKAILRCDPDVILIGEIRDSTVAKYVIQASLSGHLVLSTMHANDCKGALLRLLEMGISVQELCQAINLISNQRLITTTTNYRQLVSELMFQSQINYFFEHNHSLPKNFTKLATHLNKMSKEGVICEEVVDKYI

SEQ ID NO: 3663 - protein, 99 aa, Staphylococcus epidermidis
VRCIPMLKLNLQFFASKKGVSSTKNGRDSESKRLGAKRADGQYVSGGSILYRQRGTKIYPGENVGRGGDDTLFAKIDGVVKFERKGRDKKQVSVYAVAE

SEQ ID NO: 3664 - protein, 247 aa, Staphylococcus epidermidis
FLSIFKRRDFVLRTQFINEQTMMIYFENEISESTFKKVQQTIQYIKSKNLSEITNMIPSYRAILIYFDNSGINGTELLENLELDENSNSRKQSHFKQRIIHIPVLYGGDFGPDLSEVANVNKLSQEEVIQIHTQQPYLIYMLGFMPGFPYLGGLDAKLHTPRRSEPRIKINAGSVGIANNQTGLYPMDSPGGWQIIGRTPIKVFDLNRTPMTLYEAGDYIQFYSINYQEFEKISNDINKGKFDIDKW

SEQ ID NO: 3665 - protein, 433 aa, Staphylococcus epidermidis
TNSILRRLIIKMKTLEEVKSKTQKIMKKPELLAPAGNLEKLKIAVHYGADAVFLGGQEYGLRSNADNFTMEEIAEGVDFANRYGAKIYVTTNIIAHDENMEGLEEYLQNLESTGATGIIVADPLIIETCKKVAPRLEIHLSTQQSLSNYKAVEFWKQEGLDRVVLARETGAMEMSEMKEKVDIEIEAFIHGAMCIAYSGRCTLSNHMTARDSNRGGCCQSCRWDYDLLEVDSDGELDLYYDNSDVTPFAMSPKDLKLIESIPQMMELGIDSLKIEGRMKSIHYIATVVSVYRKVIDAYAEDPENFKIKTEWLMELNKCANRDTAPAFFQGTPGYEEQMFGEEQSKKSSYDFCGLVLDYDHETQLATIQQRNHFKPGQEIEFFGPEIDSFKQVVEAIYDEEGNSLDAARHPLQIVQIKVDKPIYSNNMMRKEIG

SEQ ID NO: 3666 - protein, 95 aa, Staphylococcus epidermidis
TKIFSSLDFFSLCTTNLLFFVFLNCRFLSMPHNGTAMKIDENTPDNNPISNAKEKLNIVGAPNINIATTTTTTVNTVLIERVIVCLIERLTISSI

SEQ ID NO: 3667 - protein, 376 aa, Staphylococcus epidermidis
GGIIVSNKDIRVVVGMSGGVDSSVTAYLLKEQGYDVIGIFMKNWDDTDENGVCTATEDYNDVIAVCNQIGIPYYAVNFEEQYWDKVFTYFLDEYKKGRTPNPDVMCNKEIKFKAFLEHALKLGADYVATGHYARIRRHDDGHVEMLRGVDNNKDQTYFLNQLSQEQLSKVMFPIGDIEKSEVRRIAEEQNLATAKKKDSTGICFIGERNFKEFLSHYLPAQSGEMLTLNGKKMGQHSGLMYYTIGQRHGLGIGGDGDPWFVVGKNLNDNVLYVEQGFHHDALYSDYLIASDYSFVNPSEIDLEKGFECTAKFRYRQKDTKVYVQRENENSIRVTFAEPVRAITPGQAVVFYNQEVCLGGATIDDVYKNEGQLSYVV

SEQ ID NO: 3668 - protein, 312 aa, Staphylococcus epidermidis
IITIRIFWKGFKLMTEHKSGFVSIIGRPNVGKSTFVNRVIGHKIAIMSDKAQTTRNKIQGVMTRDDAQIIFIDTPGIHKPKHKLGDYMMRVAKNTLSEIDAIMFMVNVNEDIGRGDEYIMEMLKNVKTPIFLVLNKIDLVHPDTMMPKIEQYQSYMDFTDIIPISALEGLNVDHFIDVLKSFLPEGPKYYPDNQISDHPEQFVVSEIIREKILHLTSEEIPHAIGVNVDRMIKEDEDRVRIEATIYVERDSQKGIVIGKGGKKLKEMGKRARRDIEMLLGSKVYLELWVKVQRDWRNKVNFIRQIGYVEDQD

SEQ ID NO: 3669 - protein, 68 aa, Staphylococcus epidermidis
SLYIRHLVNFVYWYLLNYVKGPYFSKYFNVKLHINSKYFGETLEGTGQAEDYRLKLSPKKASQQNEVL

SEQ ID NO: 3670 - protein, 162 aa, Staphylococcus epidermidis
GENMITKRQLSILNAIVEDYVDFGQPIGSKTLIHRHHLDVSPATIRNEMKQLEEMHFIEKTHTSSGRVPSESGIRYYVNRLLEQTSHQSQNKIQRLNQLLIENHYDSSTALTNFAHELCMKSQYATLVVRPNHKQDVINDIHLIRANNHLIILVMVFSFWTC

SEQ ID NO: 3671 - protein, 210 aa, Staphylococcus epidermidis
NDSITSNNNNSFWFREKTMKKLILIVGASSLLMGCGSQNLAPLEDKTTELRDDNHQLKLDIQELNQEIGEHKSKIAALKQDKENTKEASSNKLKIKNLKASSDYYDSIAKTIKDYRDIESKVNKNNNKVAIQRKLDDILNDIDGTFIKYKESVDSESQSEEDKKKEKEIRQLNKDLSSAFNTIKKGYETKDNKKIEKGQKKLATINTNLN

SEQ ID NO: 3672 - protein, 371 aa, Staphylococcus epidermidis
KLLIGGTRMTTDLKKTPLYQNYVDSGAKIVEFGGWAMPVQFSSIKEEHNAVRFNVVLFEVSHMGEIEISGKDAEQFIQYILSNDTNLLTNDKAMYSALCNDEGGIIDDLVTYKLNENHYLLIVNAANTNKDYQWIKKHSSNFTVDVSNTSDKYGQLAIQGPHSRALINELVDIDVSHMAMFEFKQNVQIFGKSIILSQSGYTGEDGFEIYCKQEDTKDIWEQLLEYDVTPCGLGARDTLRLEAGLPLHGQDLSESITPYEGGIAFAAKPLIENHFIGKSVLKAQKENGSERRTVGLELLGKGIARTGYDVLDENSNEIGFVTSGTQSPSSGKSIALAIIDRDAFEMGKKVIVQIRKRQVEAKIVKKNQIEK

SEQ ID NO: 3673 - protein, 69 aa, Staphylococcus epidermidis
VNLMTRKIKSFYDVLQLLKTYGFIIYFKNPDDMYEMMIQEIKSLYSYQLLTKDEYLNCILIINQRRNEK

SEQ ID NO: 3674 - protein, 143 aa, Staphylococcus epidermidis
GYTMKISTKGRYGLTLMISLAKREGQGCVSLKTIAEENKLSDLYLEQLVGPLRNAGLIRSVRGAKGGYQLRVPSEEITAGDIIRLLEGPITFVESIDSEPPAQKQLWIRMRDAVRDVLDHTTLKYLADYKDTNEDLEGYMFYI

SEQ ID NO: 3675 - protein, 109 aa, Staphylococcus epidermidis
IMAIVDVVVIPVGTEGPSVSKYIAEIQTKLNEFKQQGKIDYQLTPMNTLIEGDLKDLFEVIQAIHELPFDKGLDRVCTNIRIDDRRDKSRKMNDKLKSVQKHLDHSGEL

SEQ ID NO: 3676 - protein, 312 aa, Staphylococcus epidermidis
IIQIDDINQSQALIGNNDENLKAIEAHFNVVIHARGQEIAVKGEKIEHVEKAELVLKNLLKVIELGNTITLKDVEAAIKMADNNTIHHLLDLYDEEITKDAYGKTIRAKTMGQRIYINAMKRNDLVFGIGPAGTGKTFLAVVYAAKQLRKGSVKRIVLTRPAVEAGESLGFLPGDLKEKVDPYLRPLYDGLNTVLGREQTQRLIERGVIEIAPLAYMRGRTLDDAFVILDEAQNTTHAQMKMFLTRLGFGSKMVVTGDQTQIDLPKGVKSGLKEAVKKLSGVSGISIMKMDQSDVVRHPLVSKIINRYEGVE

SEQ ID NO: 3677 - protein, 197 aa, Staphylococcus epidermidis
RNQIATMNKKIVLFGGQFNPIHTAHLAVASEVYHAIKPDIFFFLPSYMAPLKHHNTQLYSEHRVKMIQLVIKEIGFGEICSTDLDRKGPSYMYETILHLKEIYHNAQLYFIIGTDQYNQLDKWYKINELKKLVTFIVVNRETDNQNVSKEMISIKIPRIDISSTMIRNRVRMNQSIKVLVPKRVENYIKEEGFYGDK

SEQ ID NO: 3678 - protein, 367 aa, Staphylococcus epidermidis
LMKISELMEVLNNHVPFHQAESWDNVGLLIGNDKLDITGILTTLDCTDDVVNQAIELNTNTIIAHHPLIFKGVKRIVEDGYGSIIRKLIQNNINLIALHTNLDVNPKGVNRMLADQIGLENISMINTNSSYYYKVQTFIPKNYIEDFKDSLNELGLAKEGNYEYCFFESEGKGQFGPVGDASPYIGKLDSIEYVDEIKLEFMIKDNELEITKRAILDNHPYETPVFDFIKMNKESEYGLGIIGQLNQTMTLDEFSEYAKKQLNIPSVRYTGQHDSPIKKVAIIGGSGIGFEYKASQLGADVFVTGDIKHHDALDAKIQNVNLLDINHYSEYVMKEGLKELLEKWLFKYENQFPIYASEINTDPFKYK

SEQ ID NO: 3679 - protein, 366 aa, Staphylococcus epidermidis
LNEILKCIGCGAPLQSENKDAPGYVPEHNMFREDVICRRCFRLKNYNEVQDVGMESEDFLNLLTGLSEKKGIIVNVVDVFDFEGSFINAIQRIVGNKKIILVANKIDLLPKQINHRRVKEWLRKSARKYGLEAEDVVLISANKGWGIDELLQSINHVRNKDDVYIVGTTNVGKSTLINKLIEQSVGEKDVVTTSRFPGTTLDMIDIPLDEKSFMFDTPGIIQSHQMTNYVSENELKIIIPKNEIKQRVYQLNEKQTLFFGGLARIDYVSGGKRPLVCFFSNDLNIHRTKTEKANDLWKSQLGALLSPPQDAQQFNLNDVKAVRLETGKTKRDIMISGLGFITIDAGAKVIVRVPKHVDVILRNSIL

SEQ ID NO: 3680 - protein, 255 aa, Staphylococcus epidermidis
RGEMKLKIDLNCDLGEAFGNYTFGGDQHILPLITSANIACGYHAGDEDVMNETVQLAKKNNISIGAHPGLPDLKGFGRRKMDLTPNEIYNLVIYQLGALSGFCKINHVKMMHVKPHGALYQMGARNKEIAHAIAQAVFDFDSNLIFVGLANTLLISEAELVGLKVASEVFADRRYEDDGQLVSRKKTDATITNTDEAIQQALKMVLENKVVSKNGKIIDLKADTICVHGDGKHALEFVTQIRNELMKEGIDIQSL

SEQ ID NO: 3681 - protein, 765 aa, Staphylococcus epidermidis
PVEMRTIIMIKSKYNWDITQPNTFISESSSDQFKLSPIVKKVLESKNIVDNQEIQNLFEGTNISHDYMLLSDMQKAIDRIKLAIDQNERILVYGDYDADGVTSTTILVSTLRLLGAQVGWYIPNRFTEGYGPNELAFKNAYDEGISLIITVDNGIQGHHEISTIQELGVDVIVTDHHEIGETLPDAFAIVHPMHPNFEYPFKYLCGAGVAYKLAQGLIEHPPQHFIALAAIGTIADLVSLTDENRYIVKQGLKILNNHTPSSIKAILNQAGFNDEITEETIGFIIGPRLNAVGRLEDASLAAELLLSDEFEEAEFLAEQVEHFNHERKDIVSKITDEALLLAEEQIKQGHLFLLLAKEGWHEGVLGIVASKIVETYALPTLILNIDENQNHAKGSARSIEQVSMFDILNDHQQLIDKFGGHHMAAGMTMSIDNIEHLRKELDMWMKELTVTTSLEPSIKVDAQLEEKEINIKNIKDIFQLRPFGTDFNSPLFMVRDLIVKSTKGIGQDNKHLKLTLGHSGLTALFWNHGHLASELEPGQPIHIIGTLQINEWNGNQTPQFIIKDIAIDQLQILDYRSKRKNIQFKESESNVAYVIHPKLKKSNSHYYHYGEAIDRPYDKIVFRDLPNTMVEIEQTLEHSQISQLYLVLQHEKSIYFEGIPSKSLFKKCYKALINKKETDLIKEGMLLCEYLNIKPEILTFMLKVFKELEFIYDEKGLIKINPAPNKQDIENSRIYQMRRARMEVEERLLYDDFLNIKEWIISKLT

SEQ ID NO: 3682 - protein, 159 aa, Staphylococcus epidermidis
ICRIGVSKLVNKDNRKFYLIREDVLPESVIKTLKVKDALKNNSNLSIYDAVKQFNLSRSAFYKYRETIFPVDEKILDQREFTLILYVNDIVGMLAQVLNAISQLQLSVLTIHQSVPIEDKATITLSLNARNSNLSIDEVIESLREINHVTKVDLISMTM

SEQ ID NO: 3683 - protein, 62 aa, Staphylococcus epidermidis
HSLIREPNRFSRSAHASIGGLAKRETGHPPVYSRPNDQAIYNYGINGLYRYARLLSCVFLCI

SEQ ID NO: 3684 - protein, 94 aa, Staphylococcus epidermidis
ILLIDRHLELYYTNNCIVLLCNDYKVPLIFGGREIQMSKTVVRKNESLEDALRRFKRSVSKSGTIQEVRKREFYEKPSVKRKKKSEAARKRKFK

SEQ ID NO: 3685 - protein, 89 aa, Staphylococcus epidermidis
LIMIQVLISILSNTDQSLNNFVLIKVQISETLCALSTFMNAISLYLESLEEYKASSWLRFLLLALGLCESFLTRLKMISMSQSSQTTCF

SEQ ID NO: 3686 - protein, 274 aa, Staphylococcus epidermidis
KEVIKVKFAVIGNPISHSLSPLMHHANFQSLNLENTYEAINVPVNQFQDIKKIISEKSIDGFNVTIPHKERIIPYLDDINEQAKSVGAVNTVLVKDGKWIGYNTDGIGYVNGLKQIYEGIEDAYILILGAGGASKGIANELYKIVRPTLTVANRTMSRFNNWSLNINKINLSHAESHLDEFDIIINTTPAGMNGNTDSVISLNRLASHTLVSDIVYNPYKTPILIEAEQRGNPIYNGLDMFVHQGAESFKIWTNLEPDIKAMKNIVIQKLKGAL

SEQ ID NO: 3687 - protein, 337 aa, Staphylococcus epidermidis
HIKMSIKILKHGLFSTIQDIGRLGYQDLGFSEAGALDYYSLSIAQKLIGNHGPAIEYTLVGPNIEFLTDNTFAIVGGDSEPKLNGNKIDLLTVYHVRNGDQLDIGQITEGARGYIVFGHPLKINKVAQSYSTHVRSGMGGFKGRALKKYDVIATQVNHNYKTNLGKTIDFSSIPDNNYIHVIEGPQINEFDEETIAKFVNSDFKISDQSDRMGYRLKGNTVAPKNSADIISEPVALGSIQVPNDGNPIILLNDKQTIGGYTKIATVTQLDLRKLAQMKPGDIIQFKWITVEEASKKLKEFNTKFEQLLKRFDEQPLFNLNQLRHTSNKIAEIIKEDR

SEQ ID NO: 3688 - protein, 385 aa, Staphylococcus epidermidis
TILVKRIKGEVIMAKRDYYEVLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGYGDLFVNIKVVTPTKLNDRQKELLKEFAEINGENINEQSSNFKDRAKRFFKGE

SEQ ID NO: 3689 - protein, 766 aa, Staphylococcus epidermidis
GVHVKKTSRIIAFILLIALLFTGMGMTYKNVVKNVNLVLDLQGGFEVLFQVDPLNKGDKIDKKALQATSQTLENRVNVLGVSEPKIQIEDPNRIRVQLAGIKDQAQARKLLSTQANLTIRDAEDHVLMSGSDIKQGSAKQEFKQETNQPTVTFKVKSKDKFKKVTEKISKKRDNVMVVWLDFEKGDSYKKEAKKQQEGKKPKFISAASVDQPINSSSVEISGGFNGKKGVEEAKQIAELLNAGSLPVDLKEIYSNSVGAQFGQDALDKTMFASIVGIALIYLFMLGFYRLPGLVAIIALTTYIYLTLVAFNFISGVLTLPGLAALVLGVGMAVDANIIMYERIKDELRIGRTLKQAYSKANKSSFLTIFDSNLTTVIAAAVLFFFGESSVKGFATMLLLGILMIFVTAVFLSRGLLSLLVSSNFFKKQYWLFGVKKMDRHDINEGKDVHDLKTSYERLNFVKLAKPLISLSILIVIIGLIIISIFKLNLGIDFSSGTRADIQSKNAITQAQVEKTVKSVGLEPDQIQINGSGNKNATVQFKKDLSREEDNKLSAKVKSEFGDNPQINTVSPLIGQELAKNAVTALILASIGIIIYVSLRFEWRMGLSSVLALLHDVFIIIAIFSLFRLEVDLTFIAAVLTIVGYSINDTIVTFDRVRENLHKVKVITHTDQIDDIVNRSIRQTMTRSINTVLTVVVVVVAILILGAPTIFNFSLALLIGLLSGVFSSIFIAVPLWGMLKKRQFKKTKNNKLVVHKEKKSNDEKILV

SEQ ID NO: 3690 - protein, 391 aa, Staphylococcus epidermidis
IYNVKTILNDLKIGGYKVNVKSAYIHIPFCYRICTYCDFNKYFIDKQPVDEYLDALISEMQVKNNRDLETMYVGGGTPTALNMRQLEKLLRAINQTFTISGEFSFEANPDELTYEKVALLKQYGVNRISMGVQTFKPELLKILGRTHKTEDIYDAVSHARKAGIESISLDLMYHLPQQTIDDFKDSLERAIALDIDHISSYGLILEPKTQFYNLYRKGHLKLPNEDLGAEMYRFLMERMKNSPFHQYEISNFGKLNHESNHNKVYWLNEEYYGFGAGASGYVNGVRYTNLNPVNHYIKAINEGKKPILSETSPTYNERMEEEMFLGLRMNQGVSKSRFKKKFNKLIDEVFGETIKDLRCRGLIKEEGEFISLTERGKVIGNEVFEAFLLNS

SEQ ID NO: 3691 - protein, 138 aa, Staphylococcus epidermidis
GRNVMSYQSHYFKEVREAQKNAYAPYSNFKVGAYLKTKDGRCFYGANVENAAYPMGICAERSSLVSAISEGYQPGDFESITVTVDADKPSSPCGACRQVMMELCDKDMPVYMTNQNGDMIEATVDELLPLGFSGKDLN

SEQ ID NO: 3692 - protein, 185 aa, Staphylococcus epidermidis
MISVNDFKTGLTISVDNGIWKVIDFQHVKPGKGSAFVRSKLRNLRTGAIQEKTFRAGEKVEQAMIENRRMQYLYADGDNHVFMDNETFDQIELPGDYLKDELNYLKANMEVQVQSYESEVIGVELPKTVELEVTETEPGIKGDTATGATKSATVETGYTLNVPLFVNEGDTLVINTSDGSHISRG

SEQ ID NO: 3693 - protein, 87 aa, Staphylococcus epidermidis
EVTVMPNIKSAIKRVRTTETAEERNISKKNAMRTAVKRAKTAISTDAENKDELLRFAIKQVDKASQSNLIHSNKADRIKSKLMSANK

SEQ ID NO: 3694 - protein, 439 aa, Staphylococcus epidermidis
NFGVKEVRYMFVDQVKISLKAGDGGNGITAYRREKYVPFGGPAGGDGGKGASVVFEVDEGLRTLLDFRYQRHFKAKKGENGQSSNMHGRNAEDLVLKVPPGTIIKSVESEEVLADLVEDGQRAIVARGGRGGRGNSRFATPRNPAPDFSENGEPGEELEVTLELKLLADVGLVGFPSVGKSTLLSIVSKAKPKIGAYHFTTIKPNLGVVSTPDHRSFVMADLPGLIEGASDGVGLGHQFLRHVERTKVIVHMIDMSGSEGRNPLDDYKIINQELINYKQRLEDRPQIIVANKMDLPDSQGNLSHFKEQLDNDVTVVPVSTITRDNIDQLLYQIADKLEEVKDVDFSVEEDENLGVNRVLYKHTPSADKFTISRDDDGAYVVSGNAIERMFKMTDFNSDPAVRRFARQMRSMGIDDALRERGCSNGDIVRILGGEFEFVE

SEQ ID NO: 3695 - protein, 189 aa, Staphylococcus epidermidis
TKWVNKMDKKGLRRNIIKKMKSYDKEQKYLADEWLAKKLYQSEAYRKANTIGFVLSMPHEVNTYPIITHSLNNNKKIFVPETNYQQQDMTFKQLLSIEDIEKDSKGIYHSISPVGTTNKMDLVVVPGVAFDKLGYRIGYGGGYYDRFLSQHKCNTVSLLYDFQLAQFNIEPHDQPVEQLIIYHNKVVEE

SEQ ID NO: 3696 - protein, 203 aa, Staphylococcus epidermidis
RIILKRRGFMEISRAKELVKEKLPDKRYQHSLRVADTAVKLAEIYDGDIKKAELAGILHDYCKYEDLSTMYQIVRQYELESDLLSYGGEILHGPVCAALMKHEFDVNDEEVLLAIKYHTTGRQQMTKTEKLVFIADYIEPGRKTPGVEEIRDMAYNQGSLDKTIYEISKRTVLFLIEKDITVYGATIACLNYYNYSDERIKDD

SEQ ID NO: 3697 - protein, 89 aa, Staphylococcus epidermidis
MEIFYKTQINKTFRTKSKNHLQSKKIWSGSFFGFVKSILSFTRMSVREINKAKRELEFVLMALNIRKVTVQRAKNNQKNYKKTISIFFQ

SEQ ID NO: 3698 - protein, 76 aa, Staphylococcus epidermidis
PFKPTRGEMRPPKINWNRPSKLEALPLPPVRSAIAIEKQSGAIEVTGHILIKKPISKTYNGRCNVKVNIKITTPNI

SEQ ID NO: 3699 - protein, 63 aa, Staphylococcus epidermidis
WSPTGIFNKMPKMTIKVMIVKNIKIIFQLAIDKARPPNSGAMMVIIPFMTIREVKNFANLFPS

SEQ ID NO: 3700 - protein, 154 aa, Staphylococcus epidermidis
  UNSURE (109),(135),(143): Identity of amino acid at the above locations are unknown.
VKVTQNENLKLAQRGAFLSLVIYIILSIAKYMTGYVYDSAAVRADALNNMTDILVSVAVIVGLKISIKPADQNHPYGHLKSENISTLLVSFIIMFVGIQVIIENFPRLXTHDSHIPNFITIIISMISGLVKLCVXAINYRLSXRTKSSSIKSAA

SEQ ID NO: 3701 - protein, 383 aa, Staphylococcus epidermidis
MSPYKVIIAPDSFKESMSAKEAALAIKDGFQEVFDSSTIYDIIPMADGGEGTTEVLKEALNATSYCVEVKDPLNRNIMASYARSDEHQTAIIEMAAASGLALLSKDERDPSITTSYGTGQLINDALNHDVNKIILGIGGSATNDGGVGMLKALGVSFKDKNNQEIRDGGLALSQIEYIDITRINPRLKDVNIKVACDVTNPLLGDNGATIVYGPQKGAQQKMIPKLDSALRHYHDKIERELNMNVKDIPGAGAAGGMGTALIAFLNAELRPGIDVVLEETQFKQRIKDANLVVTGEGKMDKQTIYGKTPIGVAKVAKSYDIPVIAICGSLGKDYEVIYHHGIDSVFSIMERPCHLDEALKEGALHVKHTTTNFARLLQLKIEN

SEQ ID NO: 3702 - protein, 413 aa, Staphylococcus epidermidis
NVYNRCYNFSRRIMMMTTSSKHLSKILIVILGVMTAFGPLTIDMYGPSLPKVQHAFGSSISEIQLTLSFAMIGLAIGQFVFGPLSDVLGRKKMALILLIGYLIASLLSVFTVHLTIFLIIRLIQGLAGGGAIVIAKASIGDNYDGNKLAKFLTSLMVINGIITIIAPLLGGLALSIASWKMIFIFLTIITLIVILGILLKMPVGLHQKQSQLNFKAIFKDFGLLLTKPTFVIPMLLQGLTYVMLFSYLSAAPFISQKMYHMTPLQYSAMFAINGVGLIVVSQITAIIVEKISRYAMLIYLTIIQMLGVVILIFTLTLHLPLYVLLIGFFINICPVTSIAPLCFSMAMAERTGGSGNASSLLGLFQFILGGLISPLVGLNGQHDMSPYLIIISATAVLLIALQIIYFKLFMKNT

SEQ ID NO: 3703 - protein, 496 aa, Staphylococcus epidermidis
RTERSTMNYLKQYESFFWLIGIFIFYLIMAILTPLSTTDWHAYKVNLSQYLTQENGRYLGHLFEWVAVHNIIIRALIYAITSFLVIYLVAYMVQLHTNRFYFILSFVLMVTVPNTIYSETYGWFTGFFSYIPATVLSLFILFTVVKMIESHDTVSEMQLWVFLLVSLFGQFFLENLSIANSLIILIGMVVYFFVKKRLSYFLIVGFMLSCIGNIIMFLNFNYFLIKDGLNTHYSISDSHGMIHKAGVTLFKLVPEYMFINQMIILTVISIVSIVLLKQNKSLKHMRVYIKIPLLLGLITLPIYKIFVYNQFHFELYKASFSIAVLNTTICFIYMISVIYVVFKMIQQRYIRMIVMGSFIAMASSVLPLLFVTPISYRNFYFIYTLWIVILLCLIQQCDVLFKQLEHIIKIFAIIISIIMMIGFTFIHISSVHRIDFIKEQITQHHRYQKITLERLPFERYTHMTTPKSKEQLQDFKHYYDLPKDITFKVVPYGTKQ

SEQ ID NO: 3704 - protein, 236 aa, Staphylococcus epidermidis
GDNMKRTDKYRDSYKYDDQYQNHRKRSEEDMYRQHQESQQRANSNRATQSENDREYENHPERYYNGRDYRREQQLEEENEKSSKTKKWLIAIIVILLIIVAIFITRAIINHNNDKVSNDPNVSQNYKKEVENQNDDINRQVDSAKSDIKNKKDTQSQIDKLQNQIDQLKQNEETNADSKFTKFYQNQIDKLKNANNAQLNNENQSKVNNMLEDINTKFDSIKAKLENILNGSNSGN

SEQ ID NO: 3705 - protein, 144 aa, Staphylococcus epidermidis
SSPIWYKTITVQRRNIMKLTRIHYEIIKFIIVGGINTFNYYITYLFLLKVLHVNYMVSHIVGFIVSFIISYYLNCYFVYKVKPTIEKFLRFPITQIVNMVMQTLLLYIFVKWLNIASEIAPFAGLIITIPVTFILSKWLLRDKV

SEQ ID NO: 3706 - protein, 271 aa, Staphylococcus epidermidis
VRLLMLHYNFYESKNQSKQLLVMLHGFISDATTYHSHIERLVEHTNVLTIDLPGHGLDTSSMDEVWDFPFITRQLDEVLIQYQTYDVFLLGYSMGGRVALYYAIHGNETLSGLLLVSTSAGIQNETDKVERAQVDAARAKVLEIAGLDIFVNDWEKLPLFRSQYNLAPEIRQSIRNNRLNQDANKLAKALRDYGTGHMPNLWPHLSLIRIPTLILVGEKDKKFVQIGQQLENHLQDSHKVQISNVGHTIHVEDSTEFDTIILGFLKEEQND

SEQ ID NO: 3707 - protein, 74 aa, Staphylococcus epidermidis
NSDPAGLKKAVMMTMMYAMAYIIAIKITEARLPKSIGKVFLPLALSLTRSRILLPILIKPIVMTIGILNHTAYP

SEQ ID NO: 3708 - protein, 79 aa, Staphylococcus epidermidis
NNHTEVDIMKVNKTIYIIVALILGGLGVHKFYADQVGQGILHLVFFWTGIPSVVAIIHAIIVIFTKKADEYGYITFDKK

SEQ ID NO: 3709 - protein, 340 aa, Staphylococcus epidermidis
KRRAFMTAIKDRDYFFDNARAILIFLVVLGHLLQPYTSEDKFLQALYLLIYSFHMPTFLFISGYFAKNLDKPNYLEKIAKKLLLPYVIFFAFFSLYYYFTGKEDAIQLDPFNPVFALWFLLTLFFFHVVLVIVRRYNPYIVLFISILVSVLAGFSGNIDSYMSISRTIVFFPIFFIGHLVTQSHTEKLRNKKWIPISIIILITFFIGYTIHPINGDWLLGSTPYTSLESNGEDVYSPLKRLLLYIIILLTMCAFLNLMPQTKRIYTYIGQRTMFVYLLHGIVIGVIRGFDLYPFKDQISIFTYLYLFISASVIVLILSSKWVCKWTNPFINLKRPSQFKN

SEQ ID NO: 3710 - protein, 141 aa, Staphylococcus epidermidis
NNMYKQLEKLITLTNNDLNLVNRRFGQRTDITSEQLELLRILYNYDRLSQYDLTMKISREQSIVSRWIKKLVQKGYIMSQQSHEDLRCKELILTEEARALIQQINTARCELIEARCQCLSSDEIASLNQLLNKLNSRHIFI

SEQ ID NO: 3711 - protein, 179 aa, Staphylococcus epidermidis
RGIHCSELLKGLGFKRYAYRHDKYGFKRDFKLYECDDCSECPLKQQCMNFNSKTNKKIMKNYNWEYFKAQINKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHYEQKEICFNK

SEQ ID NO: 3712 - protein, 317 aa, Staphylococcus epidermidis
EVVHIMSDQYQQYSTVKKYWQLMRPHTLTAAVVPVLVGTAAAKIYLLGSEDHLKFSLFLAMLLACLLIQAATNMFNEYYDFKKGLDDHTSVGIGGAIVRNGMSPKQVMNLAIAFYIIAALLGIFLAIQSSFWIIPVGIVCMAIGYLYTGGPIPISWTPFGELFSGLFMGMIIILLSFFIQTGNVQGYAVWLSIPIVITIGLINMGNNIRDRVKDKASGRKTLPILLGKRASVIFMAIMYAIAYIIVIITAFFKPAGSLFYLLVLLSFPMPIKAVRRFNKNDTPETMMPAMAATGKTNTFFGLLYALGIYISALLGAI

SEQ ID NO: 3713 - protein, 60 aa, Staphylococcus epidermidis
NSNNSLNNILHVNSPYILFDILYPVFVGAKSKICYFGKYEEIFLDVIFYQKLCSRIHLLF

SEQ ID NO: 3714 - protein, 259 aa, Staphylococcus epidermidis
LMCKAFVEAVDELGGIYYDVPYNLNEPNSDDTGRIKIKKGYQKLNGDQALAVARTRHHDSDLKRGQRQMELIKILFQKAQNLKSIDKLDNVISIVGKNAKHNLTQKEIKSLAKMYLGGSTEIKTSQLKGKDDYLNDIYYYHPSVKSIMEYSNLLRNDLDLSKITNKNDFLDQRVIKRYGSLVPLTELDEDLLRKNQKESTDSQKESDSSSQNNDEEDQTNEQTDQNSLNGNEQYPNQQDNNQTNGENGMINNDNYPYAQ

SEQ ID NO: 3715 - protein, 276 aa, Staphylococcus epidermidis
RRSKMTRQWETLREYDEIKYEFFEGIAKVTINRPEVRNAFTPKTVAEMIDAFSRARDDQNVSVIVLTGEGDKAFCSGGDQKKRGHGGYVGEDDIPRLNVLDLQRLIRVIPKPVIAMVRGYAIGGGNVLNVVCDLTIAADNAIFGQTGPKVGSFDAGYGSGYLARIVGHKKAREIWYLCRQYNAQEALDMGLVNTVVPLEQVEDETVKWCKDIMQHSPTALRFLKAAMNADTDGLAGLQQMAGDATLLYYTTDEAKEGRDAFKEKRNPDFDQFPKFP

SEQ ID NO: 3716 - protein, 1335 aa, Staphylococcus epidermidis
MAKKFNYKLPSMVALTLFGTAFTAHQANAAEQPQNQSNHKNVLDDQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDQTFKATKQQQIDKATYLYGTVNGKSGWISKYYLTAPSKVQALSTQSTPAPKQVKPSTQTVNQIAQVKANNSGIRASVYDKTAKSGTKYANRTFLINKQRTQGNNTYVLLQDGTSNTPLGWVNINDVTTQNIGKQTQSIGKYSVKPTNNGLYSIAWGTKNQQLLAPNTLANQAFNASKAVYVGKDLYLYGTVNNRTGWIAAKDLIQNSTDAQSTPYNYTFVINNSKSYFYMDPTKANRYSLKPYYEQTFTVIKQKNINGVKWYYGQLLDGKYVWIKSTDLVKEKIKYAYTGMTLNNAINIQSRLKYKPQVQNEPLKWSNANYSQIKNAMDTKRLANDSSLKYQFLRLDQPQYLSAQALNKLLKGKGVLENQGAAFSQAARKYGLNEIYLISHALVETGNGTSQLAKGGDVSKGKFTTKTGHKYHNVFGIGAFDNNALVDGIKYAKNAGWTSVSKAIIGGAKFIGNSYVKAGQNTLYKMRWNPANPGTHQYATDINWANVNAQVLKQFYDKIGEVGKYFEIPTYK

SEQ ID NO: 3717 - protein, 462 aa, Staphylococcus epidermidis
NSEEKEVKKMDVNVDEQAIVDKLYESTKDWVSVEVELNKTMKPSVLFHLTEKDAGDRFYMRLNDNYSSYFGYHAIHRFKNDFENKQSIFKDWEKLKNNIELIHPHNKYHHLRLCGGFQFSSHKSDDEWREYGLNHFVLPKVLISNEGTRTYLTYTTKRQDFDLQAFKTLVAHFEQTTMDNPEEALGDVTRMEDIYKDDWRDLVKEAIDTIDDNKKIVLARRRLVKFDKKINIPYVLNRALENEKNSYIFLLEANQSIFFSQTPEQLIKVEDGVLSTKAVAGTIKRTHNEQIDNKNIEAFLKDKKNLGEHRFVVESILNDIEPFVQDVEYNETPNILKNDHMYHLYTEIKANLNDKSYIGLIDRLHPTPALGGYPKEEALDFIENKEFGTRGLYGAPVGYIDVYDDCEFIVAIRSMLIKEQQATLYAGCGIVKNSDPDSEVAETAVKFSPMMNALGVDNNDES

SEQ ID NO: 3718 - protein, 150 aa, Staphylococcus epidermidis
GKTSENGGDTVFQIAKNQTMLDDCFEIRKCVFVEEQGVPLENEFDQYEDYSFHIVGYINGVPMATARIRPLNTHICKIERVAIIKWYRGLGYGKNLIHAIETIAKKHQYNELTMNAQLQARDFYLKLGYSPFGKVFLEENINHISMNKFL

SEQ ID NO: 3719 - protein, 103 aa, Staphylococcus epidermidis
CPRLFYCKHRQQFNLKTRLISSYFNICLNPEFQTEILQTRQVGVRGPNIENFKQKFYRQGKLGFGVCLDNALITYAPLKPFIKIQSVNKINVYSFIYITHLSL

SEQ ID NO: 3720 - protein, 201 aa, Staphylococcus epidermidis
KLSINFSYQYLKGESNVIRKAKTSDNRQIAELCYLIWRDMELDITKEITKDRIIEAIELSIVNVRYRSFYEHIWVYEKDGVVAGCVIAYPGKEEMDFEQQWLKLPLEEDILQLGTPLPEKESYDDEIYIEAVVTTPKYRGQGIATQLLKYVISTHAHEKWGLNCDYDNNKARHLYHKLGFKEDATIRLYGHQYFHMTLNNK

SEQ ID NO: 3721 - protein, 559 aa, Staphylococcus epidermidis
IIMMNHSEALTEQVFSFASELYAYGVREVVISPGSRSTPLALVFEAHPNIKTWIHPDERSAAFFALGLIKGSEKPVAILCTSGTAAANYTPAIAESQISRLPLVVLTSDRPHELRSVGAPQAINQVNMFSNYVNFQFDLPIADGSEHTIDTINYQMQIASQYLYGPHRGPIHFNLPFREPLTPDLDRVDLLTSVTKTLPHYQKSISVDDIKDILQEKNGLIIVGDMQHQAVDQILTYSTIYDLPILADPLSQLRKEKHPNVITTYDLLYRAGLNLEVDYVIRVGKPVISKKLNQWLKKTDAYQIIVQNNDQIDVFPTPPHISYEISANDFFRSLMEEPLVERKKWLQQWQSLEQQARIEISDYLKHATDEAAYVGSLIQKLTKEDTLFVGNSMPIRDVDNLLFDSEASVYANRGANGIDGVVSTALGMAAHKNVTLLIGDLSFYHDMNGLLMAKLNELHINIVLVNNNGGGIFSYLPQKRSATKYFERLFGTPTGLNFEYTALLYDFTFKRFDNLTDFKYAELSKMGSHMYEVITNRDENLHQHQNLYQKLSEIVNVTL

SEQ ID NO: 3722 - protein, 168 aa, Staphylococcus epidermidis
TYVVNILKRSANMSRKTYEKIANINGMFNVLEQQIIHSKDMALFRNEFFYVNHEHRENYEALLIYYKDSLDNPVVDGACYILALPEIFNKVDVFESDLPFTWVYDENGLSDTMKSISVPLQYLIAAALEVTDVNIFKPSGFTMGMNNWNIAQLRIFWQYCAIVRKEAL

SEQ ID NO: 3723 - protein, 395 aa, Staphylococcus epidermidis
QMKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKGQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 3724 - protein, 99 aa, Staphylococcus epidermidis; identical to SEQ ID NO: 3070

SEQ ID NO: 3725 - protein, 116 aa, Staphylococcus epidermidis
AIIPHMTPLIVNGMAIIKCFKYTGIIILAAPMSNTTLTPRELTLKDPNKKVTQAATIPIFAAPLPKPVRLIAVAIATNEIGVTINKENVTQINIDINNGFNSVNLFTNFPSDCVIT

SEQ ID NO: 3726 - protein, 97 aa, Staphylococcus epidermidis; identical to SEQ ID NO: 3072

SEQ ID NO: 3727 - protein, 79 aa, Staphylococcus epidermidis
LRIKRLWVRLLSGALILREVAQLGRALGLGPRGRRFESCLPDSKINFGGLAQLGERLLCTQEVSGSIPLVSTNINLQTT

SEQ ID NO: 3728 - protein, 359 aa, Staphylococcus epidermidis
CFKWRFNMSHSQINGKRFFNNILNAVGAGVVIALLPNALLGELLKFFKEGNHVLETIFQLVTIIQSFMAFIIGVLAAHQFKFKGTGAAIIGISAMLGSGAVHYNGQTIELKGIGDIINVILVVILACFIYMFLEGKLGSLEMIILPVLVPVISGLIGLLTLPYVQVITQSLGKLVNRFTELNPLLMSILICVTFSLLMVTPISLVAIATAINLTGLGSGAANMGIVAACVTFLFGSLRVNSLGVNVVLLIGAAKMMIPVYLKHLIIAIPLTINGVICGIIAYILKIKGTALSAGFGYTGLVGPINALNRMSGNPSMNIILLIIGYFVIPFAGAFIVHKICKKVLSTYSDEIYKFEISKD

SEQ ID NO: 3729 - protein, 311 aa, Staphylococcus epidermidis
SHILSVYIYNLIVTTVIKKINFIIFGGYHMKKRFLSICTMTIAALATTTMVNTSYAKTDTESHNHSSLGTENKNVLDINSSSHNIKPSQNKSYPSVILPNNNRHQIFNTTQGHYDAVSFIYIPIDGGYMSGSGVVVGENEILTNKHVVNGAKGNPRNISVHPSAKNENDYPNGKFVGQEIIPYPGNSDLAILRVSPNEHNQHIGQVVKPATISSNTDTRINENITVTGYPGDKPLATMWESVGKVVYIGGEELRYDLSTVGGNSGSPVFNGKNQVIGIHYGGVDNKYNSSVYINDFVQQFLRNNIPDINIQ

SEQ ID NO: 3730 - protein, 68 aa, Staphylococcus epidermidis
LCWLSNPHHLSWWETVSGGQFDWGGRLLKCNGGAQRFPQNGWKSFIECKGIRELDCETYKSSRVERRT

SEQ ID NO: 3731 - protein, 248 aa, Staphylococcus epidermidis
KRVSLMIELSHIHKSFNETEVIKGIDLKINQGEVVTLIGRSGSGKTTLLRMINALEIPTEGTVYVNGMTYNTKDKKSQIKVRQQSGMVFQNYNLFPHKSALENVMEGLITVKKMNKATANEEAMNLLAKVGLVHVKDQRPHALSGGQQQRVAIARALAMNPKVMLFDEPTSALDPELVNDVLKVIKELADEGMTMVIVTHEMRFAKEVSNQIAFIHEGVIAEQGTPEDIFNHPKTEELQRFLNVINEK

SEQ ID NO: 3732 - protein, 275 aa, Staphylococcus epidermidis
EDMFKNNKSIEDTYATKPIIQNIVGQAQIKQVMAKQTPMRYTLKAIMAGFLLSIVTVFMLAIKTQFASTHNDGLINLMGAIAFSLGLVLVVLTNSELLTSNFMYLTVGWYYKAISVSKMIWIFIFCFIGNILGGFILFFLMKYAHVMTPEMTDSLTALVHKKTVESTWLNILIKGIFCNFFINIGIFISMQFKEGLAKAFFIACGVIVFVFMGYEHVVFNAGLYAGMMFFNMDGLSWLGVLKNIVFAFLGNYIGGGIFIGLVYAYLNGKRDSLQP

SEQ ID NO: 3733 - protein, 71 aa, Staphylococcus epidermidis
YLHTFLKKPGSANGIVSMMGGIGGFFPPLVITFVTSITGSSHLAFFFLAIFGVIALITMIHLNKKEKAIRI

SEQ ID NO: 3734 - protein, 156 aa, Staphylococcus epidermidis
ATLTRDHYMYVENSYLSKQLCFLFYVSSKEIIKKYTDYLKEYGLTYTGYIVLMAIEDDEKLNIKKLGERVFLDSGTLTPLLKKLEKKNYVIRTREEQDERNLQISLTERGKDIQNVLSDISQSVFNEFNITQEETQNLVEDLQNFVTKNFDKTVEK

SEQ ID NO: 3735 - protein, 66 aa, Staphylococcus epidermidis
TRSASYNKTPKYLIRPVQVSEQTVGIPASIRGKQNVHFSALFVFQLKYTFLYGHPVIQYLQPRQAS

SEQ ID NO: 3736 - protein, 316 aa, Staphylococcus epidermidis
WRYLLMSITYPGTVYLIGAGPGNPNLLTKKAERLIRSADVILFDRLVNPFILQYASSQTKVINVGKKPYCKHIQQEEINQKIVEAANQYQCVVRLKGGDPAIFGRITEEVQTLEDHHIHYEIVPGVTSASAAVATMNMGLTMRSIAPSVTFSTGHFKDSVNHDMDIRNLINGGTLAIYMGVKRLGQIIKQIESYTNEDYPIAIVFNASCYNEKIVIGHLSTIEEQLVSQQLEGHPGICILGNILDDINRTLLNNNKNDKGNLYLIKGDKERAIAKAETLYDEGIQCLIDFDHSYHISQQNVYNEMIKHKSIKTIYV

SEQ ID NO: 3737 - protein, 212 aa, Staphylococcus epidermidis
RREYVLIVLGKGETMKKLIGLLMILCMVLLYSCSGPMDSPKHSNNSKPVVVIYGDYKCPYCKKTEDRVMPKLKKKYIDTNKIKYQYVNLAFLGKDSIVGSRAQHAVNHYAPKKSLEFQKLMFNQQKDEHKQWITTRLVDKQIDKLSISDDKKKKIKTDYKTKGSISWKKAKEDQQIAKKNHIKQTPTAFVNDNKVEDPYDFSSYEMLLENEK

SEQ ID NO: 3738 - protein, 103 aa, Staphylococcus epidermidis
SGIQVLEFLKSRFSPLSDGFNEQDLEEYRLDILEVEDVIDVNNIKGRYHGSSIFIDVTMVVDRYLSLYEAHQICDKVEIHLHNKGISSVYEHPEPYSTKDEVK

SEQ ID NO: 3739 - protein, 62 aa, Staphylococcus epidermidis
CNSHLKLKSGISLMAWIWFSRMKLRPKLKYIINYFIIYVAIEITLYAVILNHKLFYNELHSL

SEQ ID NO: 3740 - protein, 237 aa, Staphylococcus epidermidis
ILIKRKEVKVTVESTLALIVKVVVLQFNQVKLDKKFIMKISMEGSSVINLEQLSLYQDSLGYLGQQMNFPEKMTFHPKIFEETISKSHPGYEDLLAYREVMMNYTLSEIKAIYTDTFDFSKKHPLYMTFNKFDTQKERGQMLAKLKVLYEMFGLKMVDNELSDFLPLMLQFLQVADFKNDSRAQENLQLVIMIIEDGTYEMANTLAENNNPYAYVVSALRKTLKACIVPLKEVENHA

SEQ ID NO: 3741 - protein, 802 aa, Staphylococcus epidermidis
SMAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTTFTSLKVSGCDLYSAGQIVEDEDIHGVEIFNSVDNIYKKVYLSHGQVVGAVLYGDTDDGSRFYNMMKKHETLEDYTLVSLLHKGDEDAGTSIADMSDDETICGCNGVDKGTIVNAITTKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYSRIMEAKKAVENEPWETIVENKEAQKIFEVEKV

SEQ ID NO: 3742 - protein, 182 aa, Staphylococcus epidermidis
GVKNMSNINIRVAHEQDAEELHSIMQIAFTPLRELGIDWPSVHADLEMVKDNLRQNTTFVLENEKEIISTITVCYAWSSVKPISGYPFVWWFATRPTYDGQGYGSQLLKYVEETFLRDTLKAAAVTLGTSARLHPWLLNIYEKRGYEIYAKHENDDGDLGVIMRKILIPEQFNDDILGRPPF

SEQ ID NO: 3743 - protein, 381 aa, Staphylococcus epidermidis
IKMNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAFFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLVPSYFSKETRFSEWYCIHDGRNRRFLPTTGDYFCNEYHWFKSSRFLLLGYIWCNCSYYNDSFK

SEQ ID NO: 3744 - protein, 230 aa, Staphylococcus epidermidis
KRWKIMLNQFVWVIYPYLCLAIFVIGHIARYKYDQFSWTAKSSEMIEKKRLKWGSLLFHLGIIPVFFGHVVGLLIPANWLEAIGVNNHIYHIGAVYIGSVFGIITLIGMLLLTLRRLSIKNVRRLSSFSDIFVNIVLLIILIMGCYSTLVTNAIQPEFDYRQTIAIWFRHLFMFSPNADLMLNVPWSFKLHILLGFTVFACWPFTRLVHVWSVPLSYMNRRYIVYRKNKI

SEQ ID NO: 3745 - protein, 80 aa, Staphylococcus epidermidis
MNCCHRLLKQKQVQQCKVKVFSFNQTPYSYYSNRNKNILSRYYIIVNKELLANKCSESSNSINYYFKLFTNRNNYYLQIT

SEQ ID NO: 3746 - protein, 262 aa, Staphylococcus epidermidis
MKRLLLCIVALVFVLAACGNNSSNNKDNQSSSKDKDTLRVGTEGTYAPFTYHNKKDQLTGYDIDVIKAVAKEENLKLKFNETSWDSMFAGLDAGRFDVIANQVGVNKDREKKYKFSEPYTYSSAVLVVRENEKDITSFNDVKGKKLAQTFTSNYGQLAKDKGADITKVDGFNQSMDLLLSKRVDGTFNDSLSYLDYRKQKPNAKIKAIKGHAEQNKSAFAFSKKVDEKTIEKFNKGLEKIRDNGELAKIGKKWFGQDVSKPE

SEQ ID NO: 3747 - protein, 108 aa, Staphylococcus epidermidis
EGVRMKGKEKVKVTTMNEMIPQIGKKVVVNEKEIGIFLTDNGDLYAIGNICPHKEGPLSEGTVSGDYVYCPLHDQKIALKTGEVQQPDTGCVETYEVEVIDGDIYLCL

SEQ ID NO: 3748 - protein, 236 aa, Staphylococcus epidermidis
IIERKFLFMPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 3749 - protein, 453 aa, Staphylococcus epidermidis
NSLRVYKYNHAKCIYIYYIITFLNISNNSYLERISFMKKLITLIVMISFVLASCGGTSSTDKDTLNVEIPLKTKSIAPYETDIPVKTGALESLFKMSKNGKVKPLLVKNYHQVSDNQLELTLKDNIKFQNGHHLTGEAVKRSLEEGMKKSDLLKGSLPIKSINAHGQKVTITTKEPYPELMSELASPFAAIYDTKAKNKVTDQPVGTGPYKIDQYKRSQKIVLKQFKDYWQGTPKLKRINVTYHEDGNTRVDHLLSGKSDLTTDVPIERVDDVKKSNKANIQSTSGFRTHLMLYNHDSKKVNKKVREALDMIINRKDIAKNVSKNYAEPASGPFNHRLKSLEKEEIQSQDIKRAKELLAQEGYSKSHPLKLNMVTYDGRPELPKIGQVIQSEAKKANVDIQLRNVDDIEGYLKNKQSWDVSMYSYLSVPRGDTGYFFNTAYLPDGALNKGNYR

SEQ ID NO: 3750 - protein, 124 aa, Staphylococcus epidermidis
VGVSMLKKLLVGVSVLTLLLAGCMSHEYADKIDKAVKLQEKKQQKIAKNDSGDEVKHFDKKDANIYVFDKGKYVVLEYKPLSDDAEARYYTYEFKDKKAYYNKDFNAKAYYQSHEPDYKEENMY

SEQ ID NO: 3751 - protein, 159 aa, Staphylococcus epidermidis
GTYMTIEKKKNKIIFTRTFSAPINKVFDAYTKRELFEQWFHPQDASVTVYDFNATKGGNAFYAIQAPQMTSYTIAEYLQVDAPYYIEYLDYFATSKGEKDTSMPGMHITLNFEEVKGKTTVTSTSTFPTESAAQQAIDMGVETGMNSTLNQLEKLLNQK

SEQ ID NO: 3752 - protein, 347 aa, Staphylococcus epidermidis
VVNMLEQTDLSLEQLLKNYYETTNEKIVFVNRQGKIIAMNDAAKDILTEEDNYNAMTNAICHRCEGYSNEYDVQSCKDCFLETTQLQHSNFQVFMKTKDNEIKPFTAMYQNIDEQRGISAFTLQNVAPQIERQEKMYQQKMLHRSIQAQENERKRISRELHDSVIQDMLNIDVELRLLKYKHRDKVLAETSQRIEGLLSQLIDDIRNMSVELRPSSLDDLGIEAAFKSYFKQFEENYGMHIKYDSNIKGMRFDNEIETVVYRVVQEGVFNALKYAEVNEIEVSTHSDGKQLVAEVVDRGKGFSLDHHPKGSGLGLYGMRERAELVNGHVNIETHINRGTIITLDIPI

SEQ ID NO: 3753 - protein, 418 aa, Staphylococcus epidermidis
RNIMKFVNLTSEEFEQFTSENFSHYTQSSIHYNNRSKTKGDVHLVGVKDGQEDVIAACLLTEARSLKFFKYFYTHRGPVMDFNNLVLVRFFFKSLTAYLKKHNCLYVLVDPYVLENLRQPNGEIIESFDNRALIKTMEELGYKHQGYTVGYDTMSQIRWLSVLNLKDKSEDQLLKEMDYQTRRNIKKTYEMGVKVKTLPIEETNTFFELFKMAEEKHGFKFREEPYFVEMQKTYEDHAMLKLAYIDLQDYLDTLQTKHQNLNQQLKDVEKTLEENPNSKKNKTKHTQVKQQFDSNARKIRQTKEKIAEEGQVLHLAAALYIYNDHEVYYLSSGSNPKYNAYMGAYRLQWDMIQFAKEHNIDRYNFYGVTGDFSENAEDAGVQKFKEGFNAKIYEYIGDFIKPIKPLFYKVKQELESRR

SEQ ID NO: 3754 - protein, 252 aa, Staphylococcus epidermidis
LFVIMIIQKGGIIMIGNILVAHGMRKGNQNEALEEFIGTLLKDEQYYYELAFLESETQNLEIIMEKMIKQGITKFRIVPLLIFSAMHYISDIPQILKEMKARYPQIDSKMSAPLGTHPYMKTLVENRIADEKVSEGSTKATIVIAHGNGSGRFTKAHDELKAFVKTLDSHHPVYARALYGTLAFKNDLDKISEQYDELVIVPLFLFDGRLVNKVKRLLGEMTLHSQLHITPSINFDPILRLIIRERLEALDI

SEQ ID NO: 3755 - protein, 522 aa, Staphylococcus epidermidis
RRSIGLKIKAQVAMVLNLDKCIGCHTCSVTCKNTWTNRPGAEYMWFNNVETKPGVGYPKRWEDQGQYKGGWVLNKKGKLELKSGNRWSKIALGKIFYNPDMPLIQDYYEPWTYNYEHLTNAKQGQHSPVATAHSLISGDRLNLKWGPNWEDDLAGGHITGPEDPNIQKIEEDIKFQFDETFMMYLPRLCEHCLNPSCVASCPSGAMYKRDEDGIVLVDQEACRGWRYCMTGCPYKKVYFNWKTNKAEKCTFCFPRIEAGMPTVCSETCTGRMRYLGVLLYDADRVQEAASAKDEKDLYEKQLDLFLDPFDEEVIAQAEKDGINQEWITAAQNSPVYKLAIEYKMAFPLHPEFRTMPMVWYCPPLSPIMSYFEGENAGQNPDMIFPAIEEMRLPIQYLANLLTAGDTKPVKEGLQKMAMMRSYMRSQITNQPFDTSKLERLGLTERQMTEMYRLLGIAKYEDRFVVPSSHKETYLDTYKAQGSQGYGGEYFGSNCEGCGVAVQSGKTGQEIYNENFYGGIFRD

SEQ ID NO: 3756 - protein, 178 aa, Staphylococcus epidermidis
VGGIEVKIVIADDHAVVRTGFSMILNYQEDMEVVATAADGVEAYQKVLEHRPDVLILDLSMPPGESGLIATSKISESFPDTKILILTMFDDEEYLFHVLKSGAKGYILKNSPDEQLILAVRTVYQGETYVDMKLTTSLVNEFVNQSQTDEVSSSSDPFKILSKRELEILPLIAKVLWQ

SEQ ID NO: 3757 - protein, 1259 aa, Staphylococcus epidermidis
YNDFVKKCTIKIRHNTYALRKDITLYGGRINKMGKFGLNFFKPTEKFNGNWSVLEHKSREWEKMYRERWSHDKVVRTTHGVNCTGSCSWKVFVKNGVITWENQQIDYPSCGPDMPEFEPRGCPRGASFSWYEYSPLRVKYPYIRGKLLDLWTEALEEQNGNRIAAWASIVENEEKAKQYKEARGKGGHVRANWKDVTDIIAAQILYTIKKDGPDRIAGFTPIPAMSMISYASGARFINLLGGEMLSFYDWYADLPPASPQIWGEQTDVPESSDWYNASYIMMWGSNVPLTRTPDAHFMTEVRYKGAKVISVAPDYAENVKFADHWLAPHPGTDAAVAQAMTHVILQEYYENQPNDMFINYAKQYSDMPFVIMLDEDENGYKAGRFLRASDLGMSGENNEWKPVIQDKLSQQLLVPNGTMGQRWEEGKKWNLKLETEDGTPIDPMLSMVESDYHVETIQFPYFDSSGDGIFERPIATRTIQLANGEEVKIATVYDLMTSQYGVQRFEHELEATSYDDASSKYTPAWQEQITGIKKELVTKVAKEFAQNAIDTGGRSMIIMGAGINHWFNSDTIYRSILNLVLLCGCQGVNGGGWAHYVGQEKCRPIEGWNTIAFAKDWQGPPRLQNGTSWFYFATDQWKYEESNVDKLKSPLAENIKHQHPADYNVTAARMGWLPSYPQFNKNSLLFGEEAKDEGDDSNEAILQKAIESVKNKDTQFAIEDPDLRKNHPKTLFVWRSNLISSSAKGQEYFMKHLLGARSGLMAEPNEDDKPEEIKWREDTEGKLDLLVSLDFRMTATPLYSDIVLPAATWYEKHDLSSTDMHPFIHPFNPAIDPLWESRSDWDIYKTLSKAVSEMAKDYLPGKFKDVVTTPLGHDSKQEISTEYGIVKDWSKGEIEGVPGKTMPNFSIVERDYTQIYDKFVTVGPKLEKGKIGAHGVSYSVSEEYEELKSMVGTWNDDNTTSVKNDRPRIDTARKVADVILNISSATNGKLSQKSYEDLENQTGMELKDISKERASEKISFLNITSQPREVIPTAVFPGSNKDGRRYSPFTTNVERLVPFRTLTGRQSYYIDHEVFQQFGESLPVYKPTLPPMVFGARDKKVKGGQDTLVLRYLTPHGKWNIHSTYQDNERMLTLFRGGPVVWISNEDAADHGINDNDWLEVYNRNGVVTARAVTSHRMPRGTMFMYHAQDKHIETPGSEITDTRGGSHNAPTRIHLKPTQLVGGYAQISYHFNYYGPIGNQRDEYVAVRKMKEVNWLED

SEQ ID NO: 3758 - protein, 153 aa, Staphylococcus epidermidis
GESVEPESLKHNQHLQMNLDKLRAQEGYDFGGIALYDYHHTSSPIKWQYVSGNTNDRYKLIILRKGRGLAGMVMKTGKRMVIADVDTALSPEEKVKFPIILSESLTAVVAVPLWLENSMYGVLLLGQRNHQPLPQSLDQLNIEKQIGIFTEIN

SEQ ID NO: 3759 - protein, 249 aa, Staphylococcus epidermidis
LKLVRNGLVKMFLNLNNEQQHALDAAKQAFGPMLEGLVKYSIPITLVTFILGLIIALFTALMRISTSKLLRGIARVYVSIIRGTPMIVQLFIIFYGIPELGRLVTNNADNQWTLAPVIAAVIGLSLNVGAYASEIIRGGILSIPKGQTEAAYSIGMNYRQTVQRIILPQAIRVSIPALGNTFLSLIKDTSLLGFILVAEMFRKAQEVASTTYEYLTIYLLVALMYWVVCFIISIIQGWYESRIERGYRS

SEQ ID NO: 3760 - protein, 67 aa, Staphylococcus epidermidis
LKELNTTFGDKQRGQVTNEILNESKKDIPNSYITYNSQIDGVNNKVRHFNVTPESIYLIDYKLSKKE

SEQ ID NO: 3761 - protein, 78 aa, Staphylococcus epidermidis
ANLSLLIEYNILVEAYIPELPADNTLVNITAFINEAAKANPAFLNTNVKGEVAILSPPPINALLSYGINIPIMKIARM

SEQ ID NO: 3762 - protein, 567 aa, Staphylococcus epidermidis
SLMLKFHLRLLLLISTITIISFIGLGAIIHNTIYQTLTSNQIKSLDSEARNYVNLFNNNKEKEITNIAHNEKNIILIKEKDKDKIIYSSGNIKDIDHRIDNEANPSKLINKNTKLGMRYTYKNTIDDKTIYISGINNEIIDLQKDLWKYLSIVGVIVLFTVYLASRSINRTYIRPINEVTYATSLLADGYYHVRVPESNVKETRALFVTTNDLARRLQKLNNSQKIQSNRLKTTLENIPSSVLMIDKHGEIVVANHAYYQVFNPDQMVENKSYIGFIDDSIEKLIIESFRTEKVIYEQLEVAINNVHTKYFDVSCIPILTKSKKNLQGMVVVLHDITNLQKLENLRREFVANVSHELKTPITSIKGFAETLIEGAKNDEQSLDMFLNIILKESNRIESLVTDLLDLSHIEQQKELEINYMNLSELAINIIDNLQTQAYNKRIKIQSEIEKDVIIEAHENKIAQVITNLLSNAINYSSEDNKVIVRVYRNDNKVYLEIQDYGIGISETDQKRIFERFYRVDKARSRDSGGTGLGLSITKHIVEAHNGRIDVKSAPGKGSIFKVLFNDN

SEQ ID NO: 3763 - protein, 82 aa, Staphylococcus epidermidis
NNTPIAIKITTNIANMINNTIYFSSYFIILHYNVILCVVKSQNQLIDRLFLKDYTKLKIVVTRYDDDKEYSNKLQTDIKTTC

SEQ ID NO: 3764 - protein, 168 aa, Staphylococcus epidermidis
EVVTMTQITFKNNPIKLSGSEVNEGDIAPNFTVLDNSLNQITLDDYKNKKKLISVIPSIDTGVCDSQTRKFNEEASAEDGVVLTISVDLPFAQKRWCASSGLDNVITLSDHKDLSFGRNYGLVMDELRLLARSVFVLNENNKVVYKEIVSEGTNYPDFEAALKAYRNI

SEQ ID NO: 3765 - protein, 382 aa, Staphylococcus epidermidis
GHVTIRLEVDNMKIGIPKEIKNNENRVGLSPSGVHALVDQGHEVLVETNAGLGSYFEDGDYQEAGAKIVDEQSKAWDVDMVIKVKEPLESEYKFFKEELILFTYLHLANEQKLTQALVDNKVISIAYETVQLPDGSLPLLTPMSEVAGRMSTQVGAEFLQRFNGGMGILLGGIPGVPKGKVTIIGGGQAGTNAAKIALGLGAEVTILDVNPKRLEELEDLFDGRVRTIMSNPLNIEMYVKESDLVIGAVLIPGAKAPNLVTEDMIKEMKDGSVIVDIAIDQGGIFETTDKITTHDNPTYTKHGVVHYAVANMPGAVPRTSTIGLNNATLPYAQLLANKGYREAFKVNHPLSLGLNTFNGHVTNKNVADTFNFEYTSIEDALK

SEQ ID NO: 3766 - protein, 126 aa, Staphylococcus epidermidis
RGMTMTKNIPTNYKLISKQLASLIEDEKNLIAILSNTSALLNDTIDQINWVGFYLIENNELILGPFQGHPACVHIAIGKGVCGTAVSSGETQRVKDVHQFPGHIACDANSQSEIVILITSSSTTGY

SEQ ID NO: 3767 - protein, 443 aa, Staphylococcus epidermidis
KDCYKEIRGNGMTKNEQIIKHIESLSIGSKISVRKIAKDLNVSEGTAYRAIKDASQLGIVATIDRVGTVRIEKRSRENLDNLTFNEIANIVEGQILAGRAGLNKSVSKFAIGAMQFDDILKYIGKHTLLIVGNRENVQIEALKRETSILITGGFRPSAEIIRYADEHELPIISSSYDTFLVANIINKAMFNQKIRKEILVVEDIVKPINELSVLFDSMTIHDYKKIANETGHTRFPIVNEEFKLVGIVTSREIINMNEEDLLGKVMTKNPLSVKLTNTVASCAHLLIWEGIELLPVTDNNKKAVGVINRQDVLKSMQLLGRQPQIGETVNDQIAKHISIHQQGINVDVSPLITNHYGTLSKAVFVGIIEETIRHEMRKYKKGNVMIESMSIIYIKTVPIESTIEVHYEMLDVGRYFAKLEVTMINNGEKVANALVICQMFDGF

SEQ ID NO: 3768 - protein, 568 aa, Staphylococcus epidermidis
EEKYMVLFIILAILVVILIAIGVLFYMRSNKRNLIEKTEERKNEIEQLPLDDNLRKLTGLNLKGETKTKYDAMKKDNTETTNKYLAPVEEKIQNAEELLEKFKFTAAQTEIDDAHELMDQYEENYQHQVTQVDDIINLHKENEALYEKCKVDYREMKRDVLANRHQFGEAAEPLENEIENYEPKLNEYENLKSEGNYVQAHNHIAALEDQIKNLKSYMDEIPELIRETQKELPGQFQDLKYGCRDLKVEGYDLDHVKVDGTIQSLKTELSFVEPMISRLELDEANNKLENINDKLDEMYDLIEYEVKAKNEVEETKDIITDDLFKAKDMNYTLQTEIEYVRENYYINESDAQSVRQFENEIQSLISVYDDILKETSKSAVRYSEVQDNLQYLEDHVSVINKEQDKLQNHLIQLREDEAEAEDNLLRVQSKKEEVYRRLLASNLTSVPERFIIMKNEIDNEVREVNEQFRERPIHVKQLKDKVAKIVIQMNTFEDEANDVLVNAVYAEKLIQYGNRYRKDHHHVDKSLNEAERLFKNNRYKRAIEIAEEALESVEPGITKHIEEQVIKE

SEQ ID NO: 3769 - protein, 370 aa, Staphylococcus epidermidis
KLYLISIELIYHHMMEVHYMTKIKEIKKVLQKEDADAAWITTPLNIFYFTGYRSEPHERLFALLIPSNEEPVLFCPKMEVEEVKQSPFKGKIIGYLDTENPFDKYSKTFSKMLIESEHLTVKRQRELTKAFNIEHYQDVDQSIKDLRNIKSEDEIINIKKAAALADKCIEIGKSFLKEGVEEREVVNHIENEIKKYGVNEMSFDTMVLFGDHAASPHGTPGDRKLQQNEFVLFDLGVVYHHYCSDMTRTIHFGTPNKEAQNIYNIVLKAETEAIKSIKPGVTIKDIDKIARDIIEEAGYGDYFPHRLGHGLGLEEHEYQDISSVNNNQLEAGMVITIEPGIYVPHVAGIRIEDDILVTENGYEILTQYEK

SEQ ID NO: 3770 - protein, 386 aa, Staphylococcus epidermidis
KPFHKETVKGKFIMAELKRGLEGVIAAETKISSIIDSQLTYAGYDIDDLAENAQFEEIIFLLWNYRLPNENELSELKEKLFDYMTLNNRVYKHFEEYVTDHVHPMTALRTSVSYVAHFDPEAENESDENKYDRAIRIQAKIASLVTAFARVRDGKEPVKPNSELSYAANFLYMLRGELPTEVEVEAFNKALILHADHELNASAFTARCAVSSLSDMYSGVVAAIGSLKGPLHGGANERVMSMLKEIGSIDNVDHYLDERFANKDKIMGFGHRVYKDGDPRAKYLREMSRKITEETGQSELFEMSLAIEKRMKEEKGLIPNVDFFSATVYHSMNIPHDLFTPIFAVSRTSGWIAHILEQYRDNRIMRPRAKYIGEQNRKYVSIEERP

SEQ ID NO: 3771 - protein, 456 aa, Staphylococcus epidermidis
GSCLMAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTARRNQRSRKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 3772 - protein, 456 aa, Staphylococcus epidermidis
MGLQTYEYGLKPQDGFEVITHFEFTSQHLDILNRLFTPLIGVESIGLYHFMSQFIDESQQLGLTHYIFMNELKINLLDFREQMDNLEAIGLIKTFVRHEKKYSHFVYELIQPPTAYQFFNDPMLSVFLFSEVDKKRYQALKSYFEKDEKDLSKYQQTTRKFTEVFNVPKKVNVSDQINLKQIKHYDGIDLSNETFDFEMLRQMLNHHFISNEIIDKEAKNLIIQLATLYGITEDGMKNVILSSITSAQQLSFEEMRKKARTYYLIEHDNQLPKLEHQTNKINDEKKDRQAEDTTNDWLQLLDETSPIDMLASWSDSEPTQSQKSMIEELINREKMNFGVINILLQFVMLKEDMKLPKSYIFEIASNWKKIGISNAKQAYEYALQVNQPKNYETHSNDKRQNNRGRQNQFLSKEKTPKWLQNRDDQEENKEINDDTLEEDRQAFLEKLNQKWKEEDN

SEQ ID NO: 3773 - protein, 412 aa, Staphylococcus epidermidis
GAVKVMQYDHLLVRYGELTLKGTNRKMFVNQLKDNVKRALIPLSGYHVKGKRDRMYIELSPEADINEIIQRLSKVYGIKSISPVIKIDKNEEKINQSAIQLSHDFEKGSTFKVDVKRVDKSFRLDTYELQRQVGGAILKKNNNITVNVKNPDYEIKIEVRMDAIYIYEKVIAGAGGLPVGTGGKTLLMLSGGIDSPVAGIEVMKRGVTVEAIHFHSPPFTSEKAKDKVIELTRILAERVGPIKLHLVPFTEIQKQINKVVHPRYTMTSTRRMMMRISDKVVHQINANAIVNGENLGQVASQTLKSMYAINHVTATPVLRPLLTLDKEDIIKKAKELGTFETSIQPYEDCCTIFTPKNPVTEPDFDKVIKYESVFNFDEMIENAVENIETLTIDQNYKSAKEQSTDSLIKDLF

SEQ ID NO: 3774 - protein, 345 aa, Staphylococcus epidermidis
WNVKKIYGNLELKINLVKERYVVMKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 3775 - protein, 128 aa, Staphylococcus epidermidis
IRTNDNAIMISGFKIFAGMYVAMIAPPPEATNISGNIFPTIFKSTLPERKNFNALVNVLKELANLFVPKATDGGKPTASNAGVEISPPPPTTESTNEAIKPKATIINIIDKFQSILSLTPLFLLHYEF

SEQ ID NO: 3776 - protein, 138 aa, Staphylococcus epidermidis
FMYKHILLGVDTQIKNEKALKEVSRLAGEGTIVTVLNAINEQDAQASIRAGVHLDKLTEKRSKGLESTLKTLEDYGIDYDEVIVRGNAKDELLKFANSGKYEIIVLSNRKAEENKKFVLGSVSHKVAKRATIPVLIVK

SEQ ID NO: 3777 - protein, 295 aa, Staphylococcus epidermidis
RKDNIMPELPEVEHVKRGIEPFIKSAKIEKVTFAKNVINGKNNNRETIIKGMELDTFKKLTEGYVIKKVERRSKYIIFYIADHDDDRILVSHLGMAGGFFVVNNLDEISTPNYRKHWQVIFDLDNKQKLVYSDIRRFGEIRNIVNFDSYPSLLEIAPEPFEEVAFEHYLECLTMKKYKNKPIKQTILDHRVIAGAGNIYACEALFRAGITPDKITNSLTKQERKSLFYYVREVLEEGIKYGGTSISDYRHADGKTGQMQLHLNVYKQKKCKVCGHSIETKVIAGRNSHFCPNCQR

SEQ ID NO: 3778 - protein, 476 aa, Staphylococcus epidermidis
CGNKLASTYEGKGASMKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITSMGIPL

SEQ ID NO: 3779 - protein, 245 aa, Staphylococcus epidermidis
MYKKIRRHTMSQKILVVDDEQSIVTLLKYNLETAGYIVEVAYDGEEALKKVETEQPELIVLDVMLPKKDGIEVCKTIRSDKNLVPILMLTAKDDEFDRVLGLELGADDYMTKPFSPREVVARVKAILRRSQFVNEIEKEDVDDEDIIIGSIRIRPEFFEVYKEDELLELTPKEFELLLYLIERQGRVITREHMLNSVWNYEFAGDSRIVDVHISHLRDKLEENPKQPKLIKTVRGLGYKLERPKA

SEQ ID NO: 3780 - protein, 264 aa, Staphylococcus epidermidis
CNKNKGVRLNMDWNLSIMLMIVAFGFIASFVDSVVGGGGLISTPALLAVGLPPSVALGTNKFASSFSTLTSALKFLRSGKVDLKIVGKMFPLIFVASGGGAIIATYIPANILKPLIIIALSLVLIYTVIQKDWGNIRTFTDFTFTKAVLFTLIFIVIGFYDGFLGGGTGSFMLFTLLLFGFDFLSAAGNAKVLNFASNCGALLFFMILGQVNYFYGIIMASSMMIGVLLGAQFALKKGVGYVKALFLVVTAILIIKNLYDFIVQ

SEQ ID NO: 3781 - protein, 650 aa, Staphylococcus epidermidis
IGGKNMNQINIQFPDGNTKEFDKGTTTEDIAQSISPGLRKKAVAGKFNGQLVDLTRPLEQDGAIEIITPGSEEALEVLRHSTAHLMAQALKRLYGDVKFGVGPVIEGGFYYDFDMDDKVSSDDFDKIEKTMKQIVNENHKIVREVVSKEKAKDFFKDDPYKLELIDAIPEDESVTLYTQGEFTDLCRGVHVPSTSKIKEFKLLSTAGAYWRGNSDNKMLQRIYGTAFFDKKDLKAHLKMLEERRERDHRKIGKDLELFTNNQLVGAGLPLWLPNGATIRREIERYIVDKEVSMGYDHVYTPVLANVDLYKTSGHWDHYQEDMFPAMKLDEDEAMVLRPMNCPHHMMIYKNKPHSYRELPIRIAELGTMHRYEASGAVSGLQRVRGMTLNDSHIFVRPDQIKEEFKRVVNMIQDVYKDFGFEDYRFRLSYRDPEDKHKYFDDDEMWEKAESMLKEASDELGLTYEEAIGEAAFYGPKLDVQVKTAMGKEETLSTAQLDFLLPERFDLTYIGQDGEQHRPVVIHRGVVSTMERFVAFLTEETKGAFPTWLAPMQVEIIPVNIDLHYDYARLLQDELKSQGVRVEIDDRNEKMGYKIREAQMKKIPYQIVVGDQEVENQEVNVRKYGSEKQESVEKDEFIWNVIDEIRLKKHR

SEQ ID NO: 3782 - protein, 905 aa, Staphylococcus epidermidis
CVVNTKLAYSLCICIYAKIYVNLFWRLRILNKLVLIDGNSLSFRAFYALPLLSNHAGIHTNAVYGFAMLLEKIIKEEKPNHFLVAFDAGKTTFRHSKYSEYKGGRQKTPPELSEQFPYIRQLLDAYHIKRYELDNYEADDIIGKLSRQADEEDFETIIITGDRDLTQLATDNVTIYYTKKGVTDVDHYTPKFIAEKYNGLVPKQIIDMKGLMGDTSDNIPGVAGVGEKTAIKLLNQFESVEGVYEHIEEVTAKKLKEKLINSKDDALMSKDLATINVHSPIEVSLEDTKLTLQDDTTEKIELFKKLEFKQLLADIDTSSTNEEVIDKTFEIEQDFQNVDLNDLNEAVIHFELEGTNYLKDTILKFGFYTNHQHVVINAEDVKDYKHLVQWLEDKNTTKIVYDAKKTYVSAHRLGINIENIEFDVMLASYIIDPSRSIDDVKSVVSLYGQNYVKDNITIFGKGKKHHIPEEPILNEHIASVTEAIAAVTPTMKSQLEDYNQIELLKDLELPLARILSEMEEIGIYTDINDLKEMEFEIQKKLDVLISNIHESAGEAFNINSPKQLGVVLFETLQLPVIKKTKTGYSTAVDVLEKLQGEHPIIDDILEYRQLAKLQSTYVEGLQKVISKDHRIHTRFNQTLAQTGRLSSIDPNLQNIPIRLEEGRKIRKAFKPTSKDSVILSADYSQIELRVLAHITQDESLKHAFINGHDIHTATAMKVFNVESDQVDSLMRRQAKAVNFGIVYGISDYGLSQSLGITRKQAKAFIDDYLASFPGVKQYMSDIVKDAKAQGYVETLLHRRRYIPDITSRNVNLRSFAERTAMNTPIQGSAADIIKLAMVKFSEKIKETKYHAKLLLQVHDELIFEIPKSEVEDFSKFVEEIMEQALVLDVPLKVDSNYGATWYDAK

SEQ ID NO: 3783 - protein, 341 aa, Staphylococcus epidermidis
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVADKIGQLIDDKAMVKAI

SEQ ID NO: 3784 - protein, 388 aa, Staphylococcus epidermidis
LKFEGEVLSVIYLDNAATTKADQDVVDSFVKVNQTLYFNPNSPHHAGVQAEQLLLKAKSEINRILNLNNQFDIIFTSGATESNNILLKGIAYMKKETANEIITSVLEHPSVLEVMRYLEREKGFKLKYVDVTKEGKLDTEHLKSLMTDKVGLVTCMYVNNIMGQIQPIEEIANIVKNYPRAHFHVDAVQALGKVPMQINHIDSLSLSGHKFNGLKGQGLLLLKNIQNIEPIVHGGGQEYGLRSGTINLPMAISMVRAIKNAVDQTKELNLRLSNYKNKLLSFLAEYKNVFINSPQNASPHIINIGFPGVKGEVLVNAFSKQNVMVSTTSACSSKMNKLNEVLLAMEIAESKIEGSIRISLGAHTTENDILSFMNAFESVYKEIKELLK

SEQ ID NO: 3785 - protein, 208 aa, Staphylococcus epidermidis
RKSEIMSKVIGITGGIATGKSTVSELLTAYGFKIVDADIASREAVKKGSKGLEQVKEIFGEEAIDENGEMNRQYVGEIVFNHPDLREALNEIVHPIVREIMEQEKNNYLEHGYHVIMDIPLLYENELQDTVDEVWVVYTSESIQIDRLMERNNLSLEDAKARVYSQISIDKKSRMADHVIDNLGDKLELKQNLQKLLEEEGYIQSESE

SEQ ID NO: 3786 - protein, 315 aa, Staphylococcus epidermidis
LMLDFEKPLFEIRNKIDSLKESQEKNEVDLQDEIDMLEASLKRETTKVYTNLKPWDRVQIARLPERPTTLDYIPYIFDSFIELHGDRSFRDDPAMIGGIGYLDGKSVTVIGQQRGKDTKDNIYRNFGMAHPEGYRKALRLMKQAEKFNRPIFTFIDTKGAYPGKAAEERGQSESIAKNLMEMASLTVPVIAVVIGEGGSGGALGIGISNRVLMLENSTYSVISPEGAAALLWKDSNLAQIAAETMKITALDLLDLGIIDEVINEPLGGAQKDEEVQALSIKKMFLKHLNELNQLTPEELANDRFEKFRKIGSVVE

SEQ ID NO: 3787 - protein, 69 aa, Staphylococcus epidermidis
RHLEASNLILSISTIIIFQLIILLLLLLFKYRNISPLYLFFIFFVNYKKYNIDDIWCSTLKSITSVIKG

SEQ ID NO: 3788 - protein, 62 aa, Staphylococcus epidermidis
SILLFEKIPLLHEEAAAVKTTKLIIPAANGIPINANNLTNGLLSGSTLSHGIMDMMTANAPT

SEQ ID NO: 3789 - protein, 323 aa, Staphylococcus epidermidis
IIFRSLKGVINMEVKMNEIMEALEQSELIIIHRHLRPDPDAYGSQLGLKYYLQKKFPNKQIYAVGANEDSLKFIGLMDEIDDDMYKKATVVVCDTANAPRIDDQRYDTGTKLLKIDHHPATDQYGDINYVNTKASSTSEIIYEFILHFNDEHIIDEQVARVLYLGIVGDTGRFLFNNTTPRTMQITGKLLTYPFDHNQELNKMSEKDPKLLPFQGYILQNFDLNDKGFCKVKITKDILEKFQIQPNEASLFVNTIADIRGLKIWMFGVDEGDQIRCRLRSKGHIIINDVANTFGGGGHPNASGVSVNSWEQFEQLAEALNDKL

SEQ ID NO: 3790 - protein, 409 aa, Staphylococcus epidermidis
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPISLDTTDTQEIIKTVKLIAPNYGGINLEDISAPRCFEIEETLKKETNIPIFHDDQHGTAIVTMAGLINALKIVDKELTNIKVVLNGAGAAGIAIVKLLHAYGVNNMIMCDSKGAIYSGRNFGMNDTKTYVAKWTNKDKVEGSLEEVIKDADVFIGVSVADILTQDMVKTMADDPIIFAMANPNPEINPNEAKQAGAKVVGTGRSDFPNQINNVLAFPGLFRGALDVEATHINEDMKKAAVEAIVHLIDENELHPDYCIPGPFDKRVAPSVAKNVAKAAMESGVARIKIDTQEIFDKTMKLTDLK

SEQ ID NO: 3791 - protein, 601 aa, Staphylococcus epidermidis
ISKRIINLNLFGRIIKMRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 3792 - protein, 307 aa, Staphylococcus epidermidis
LMKSFRNIMGDSQNLDKRIQKIKQNVINDTDVKHFLEKNRSNITNEMIDEDLNVLQEYKDQQKVYDGHRYDDCPNFVKGHVPELYIENERIKIRYLPCPCKIKHDEERFDSQLITSHHMQRDTLHAKLKDIYMNNRERLDVAMAADQICTAITNDEKVKGLYLYGPFGTGKSFILGAIANQLKSQKISSTIVYLPEFIRTLKGGFKDGSFEKKLQRVREANILMLDDIGAEEVTPWVRDEVIGPLLHYRMVHELPTFFSSNFNYSELEHHLSITRDGTEKTKAARIIERIKTLSTPYYLTGKNFRNN

SEQ ID NO: 3793 - protein, 425 aa, Staphylococcus epidermidis
TNDGGQCLMSKLILAVNAGSSSLKFQLIKMPEEKLVTKGVIERIGLSDSIFTIHVNGEKLTDIRDIHNHEEAVNIMLDSFKEHEMIKDITDIQGTGHRVVHGGETFPKSVVVTDEVESQIEELSELAPLHNPANLMGIRAFRKLLPEIPHVAVFDTSFHQTMPEQAYLYSLPYHYYEDYGIRKYGFHGTSHKYVSRRAAQIVGRPIEDLRIISCHIGNGASIAAIDGGESIDTSMGFTPLAGVTMGTRSGNLDPALIPFIMEKTGKTADEVLEILNKESGLLGLTGTSSDLRDLTEEAKHGRQRSRVALDLFASKIHKYIGSYAARMHGVDVIVFTAGIGENSHIIRGKVLEGLEFMGVYWDPKKNESLHGEEGYINYPHSPVKVLVVPTDEEVMISRDVIKYGKLNDNTPKKEEFDTNESIEVN

SEQ ID NO: 3794 - protein, 68 aa, Staphylococcus epidermidis
SLYIRHLVNFVYWYLLNYAKGPYFSKYFNVKLHINSKYFGETLEGTGQAEDYRLKLSPKKASQQNEVL

SEQ ID NO: 3795 - protein, 189 aa, Staphylococcus epidermidis
LLLIKYSVYYVKIELRKIKGAIMMISYKNILIAVDGSHEAEWAFNKAVGVAKRNDAQLTIVNVIDSRTYSSYEVYDAQFTEKSKHFSEELLKGYKEVATNAGVKNVDTRLEFGSPKAIIPKKLARDVGADLIMSGTSGLNAVERFIVGSVSEAIVRHAPCDVLVVRTEEMPEDFQPQVATPQLREKYQD

SEQ ID NO: 3796 - protein, 167 aa, Staphylococcus epidermidis
CTVIKLGRVTYMKCPKCNSTHSRVVDSRHADEANAIRRRRECENCGTRFTTFEHIEVSPLIVVKKDGTREQFLREKILNGLVRSCEKRPVRYQQLEDITNKVEWQLRDEGQTEISSREIGEHVMNLLMHVDQVSYVRFASVYKEFKDVDQLLESMQGILSDNKRSDK

SEQ ID NO: 3797 - protein, 90 aa, Staphylococcus epidermidis
VKLVLPNGVLNANKIMITPITIKAMIVTILMIANQNSSSPNNFALNKLKDIRISTQNKALIQLGMSGNQKLIYLATAVTSAIPVIIQHSQ

SEQ ID NO: 3798 - protein, 63 aa, Staphylococcus epidermidis
NISVSGFFINNKFKINLFLSYLEHSLCLNFIFLLLKFPLRKYMLKLLFRIIVKGKFITFIKIM

SEQ ID NO: 3799 - protein, 337 aa, Staphylococcus epidermidis
LFRVNSYYQSRMDTFLNRKGYFMSEENTIMERLFHKLDDKAKTLNKENGQSFIENLGLAMEDIYTNQRELLEQATLQDRRKAFQFAYLSLLQEENIQANHQITPDSIGLILGFLVQRFLEHKKEMHIVDIASGAGHLSAAVKEVLSDKTIMHHLIEVDPVLSRVSVHLANFLEIPFDVYPQDAIMPLPLEEADVVIGDFPIGYYPLDERSREMKLGFEKGHSYSHHLLIEQSINALKGAGYAFLVVPSHLFEDDKVKQLENFIATETEMQAFLNLPKTLFKNEKARKSILILQKKKSGETRPVEVLLANIPDFKNPQQFQGFISELNQWIVTNHTKK

SEQ ID NO: 3800 - protein, 1067 aa, Staphylococcus epidermidis
ETMVAHLNIHTSFDLLDSSLRIDALIDKAKKEGYRALAITDTNVLYGYPKFYDACIAAHIHPIFGMTIYLTDGLYTIETVVLAKNNQGLKSLYQISSAIMMRNKEEVPIEWLKRYDEHLIIIFKEAELSHKQIIDAFEGKKELYLNHNSNNTLTGKRVWMQSARYLNEDDAETIPALHAIRDNTKLDLIHEKETLDEHFPSIEELQTLNLSEDMITNANEIEELCQAEIAYHQSLLPQFVTPNGETSKDYLWTILIHRLREWELNDKTYFNRLKHEYKIITDMGFEDYFLIVSDLIHFAKTHEVMVGPGRGSSAGSLVSYLLGITTIDPLKYNLLFERFLNPERVTMPDIDIDFEDTRREKVIKYVQDKYGEHHVSGIVTFGHLLARAVARDVGRIMGFDETSLNEISKLIPHKLGITLEEAYQKPEFKAFVHRNHRNERWFEVSKKLEGLPRHTSTHAAGIIINDQPLFKFAPLTTGDTGLLTQWTMTEAERIGLLKIDFLGLRNLSIIHQIILQVKKDLNINIDIEAIPYDDKKVFDLLSNGDTTGIFQLESDGVRSVLKRLQPEHFEDIVAVTSLYRPGPMEEIPTYITRRHNPNQVAYLHPDLEPILKNTYGVIIYQEQIMLIASQVAGFSYGEADILRRAMSKKNRAILESERQHFIDGAKNNGYGEQISKQIFDLILKFADYGFPRAHAVSYSKIAYIMSYLKVHYPHYFYANILSNVIGSEKKTAAMIDEAKHQRISILPPNINQSHWYYKASNKGIYLSLGTIKGIGYQSVKLIIDERQQNGPYRDFFDFSRRIPKRVKNRKLLESLILVGAFDTFGKTRATLLQAIDQVLDLNSDVEQDEMLFDLLTPKQSYEEKEELPDQLLSDYEKEYLGFYISKHPVEKKFEKKQYLGIFQLSNGSHYQPILVQFDHIKQIRTKNGQNMAFVTMNDGRTMMDGVIFPDKFKKYETSISKEQMYIVLGKFEKRNQQMQLIINQLFEVEAYEQTKLSNSKKVILRNVTHLEPQFEHSKVESNEQHALNIYGFDESANKMTMLGQIERQRQNFDLLIQTYSPADIRFI

SEQ ID NO: 3801 - protein, 428 aa, Staphylococcus epidermidis
NMEVNCMSAEKITQSKDGLNVPNEPIIPFIIGDGIGPDIWKAASRVIDAAVEKAYNGEKRIEWKEVLAGQKAYDETGEWLPQETLETIKEYLIAVKGPLTTPIGGGIRSLNVALRQELDLFTCLRPVRWFKGVPSPVKRPEDVDMVIFRENTEDIYAGIEFKQGTSEVKKVIDFLQNEMGATNIRFPETSGIGIKPVSKEGTERLVRAAIQYALDNNRKSVTLVHKGNIMKFTEGSFKQWGYDLAHNEFGDKVFTWQQYDEIVEQKGKDAANEAQSKAEQEGKIIIKDSIADIFLQQILTRPAEHDVVATMNLNGDYISDALAAQVGGIGIAPGANINYETGHAIFEATHGTAPKYADLNKVNPSSEILSSVLMLEHLGWQKAADKITDSIEATIASKIVTYDFARLMDGAKEVSTSDFADELIKNIR

SEQ ID NO: 3802 - protein, 243 aa, Staphylococcus epidermidis
GILLKDITFRRVTLMKLSFHGQSTIYFEGNGKKVIVDPFISGNDKCDLDEQTLEVDYIILTHGHADHFGDVVELANRNHATVIGSAELQGYLSTYHGVENVHGMNIGGKAKFDFGTVKFVQAFHSSSFTHDNGVPVYLGMPMGIIVEAEGKTIYHTGDTGLFSDMKLIADRHPVDVCFVPIGDNFTMGIEDASYAINEFIKPTISVPIHYNTFPLIEQDPEQFKDAVQVGEVQILKPGESVEF

SEQ ID NO: 3803 - protein, 293 aa, Staphylococcus epidermidis
QRIFGGLPMFKDFFNRSKKKKYLTVQDSKQNDVPAGIMTKCPKCKKIMYTKELNENLNVCFNCDHHIALTAYKRIEAISDEGSFIEFDRGMTSANPLDFPGYEEKIEKDQQKTGLNEALVSGTAKLDGIQYGVAVMDARFRMGSMGSVVGEKICRIIDYCTEHRLPFILFSASGGARMQEGIISLMQMGKTSVSLKRHSDAGLLYISYITNPTTGGVSASFASVGDINLSEPKALIGFAGRRVIEQTINEKLPDDFQTAEFLLEHGQLDKVIHRKDMRETLSNILKIHQEVSN

SEQ ID NO: 3804 - protein, 102 aa, Staphylococcus epidermidis
STALDLEKMIPTTKITVNRANIIPKIRFAVKKEKIESAADRIVKTINPILKNFCLLFFCVCSSSKVSFNFSYKFSFSCNSKTCCVYSFFFSKVSSGTSSFST

SEQ ID NO: 3805 - protein, 420 aa, Staphylococcus epidermidis
MIFTSMSHKVVVLMNNEALTLFRKRQQAIRKEKNYYNKFIFNGHFTVFLLILLGAFIFGYGEWLSHIPPQIDYALFASIALAVVSLFPIRTLLKEADQIFLLPFERHMKNYINASLFYSYISRISLPFILLIVFFPLFYKLSHNHYGFYIAFSISTLLYPYLVLLIKWQWVKLNKNVFIINILLFIPLAVTHYMILRFHNYLAFLIMIILFVIYLVLKTKADHYLLPWEKVIAIEQQHHTNYYKFVNMFTDVKHLRESAVRRSYLDFLLPVPKGAKFNENRMYLYLFIRSFVRGRDAFSIILRLVIIAIILMVWLSQPVVSLIIGSLFMYIILLQMSQFYTQQAYGLWPQVWPVSDTKVIAGYQQFLNRLMIIIAITFTIVYVIKHHDLFFFAVLFFIVGWLTIRNAVKKLKYQETLLRD

SEQ ID NO: 3806 - protein, 207 aa, Staphylococcus epidermidis
MFETITTAAILYIATAVDLLVILLIFFARANNYQQYKDIYIGQYLGSLTLIFVSLFFAYVLNYVPDKWILGLLGLIPIYLGIKVAIFDDCEGERRAKDELNKKGLSELSKSVAVVTLASCGADNIGLFVPYFTTINNYELVITLITFVILIFILVFTAQKLANIPGLGEVIERFSRWIMSIVYIGLGLFIIIENGTVQKLFHFVFLV

SEQ ID NO: 3807 - protein, 173 aa, Staphylococcus epidermidis
RSAARNEKRFANEERTKMTNHIVLYQPEIPANTGNIARTCAGTLTHLHLIKPLGFSTEDKMLKRAGLDYWEHVNITYHDSIEEFFANTEGHYYLLTKFGKQTYSDFNFSNTNEDYYFIFGKETTGLPEWVKEKYAKTALRIPMSDNIRSLNLSNTAALLIYEALRQQDYPNLS

SEQ ID NO: 3808 - protein, 168 aa, Staphylococcus epidermidis
AMYLYTSYGTYQFLNQIKLNHQERNLFQFSTNDSSIILEESEGKSILKHPSAYQVIDSTGEFSEHHFYSAIFVPTSEDHRQQLEKKLLHVDVPLSNFGGFKSYRLLKPTEGSTYKIYFGFANRTAYEDFKASDIFNENFSKDALSQYFGASGQHSSYFERYLYPIEDH

SEQ ID NO: 3809 - protein, 386 aa, Staphylococcus epidermidis
NIFYLKGVYMMHTILLVVFMIILGAIIGGVTNMIAIKMLFHPFKPYYIFRFRIPFTPGLIPKRREEIARKIGQVIEEHLITEELIRQKLNQPQSRNMIQQLIHKQISKLKNDDVTIKKIAGFLGIDVNELVDYKLTTKFLNKLNFWYESNKYRKLSEILPQSFLDQCKGQIEYITDFLCERARNYLSSEKGERDIYEMLDTFFNEKGRIIGLLQMFMTKESIADRIQHELIRLTQHPQSQKIITKVLNDEYETFKDKNLDEIIKEQQFKNYSQLVLNELKTYLNLKDKTERPIKQVVPQFIQFLEDDTSKRMTDFIIKGTSKHLTNIMKKINLRQLVEEQINTFDLKYIENLIIDIANKELKLIMTLGFILGGIIGFFQGVIAIFV

SEQ ID NO: 3810 - protein, 417 aa, Staphylococcus epidermidis
TILYIFSINFADILRRIKLMVKFIHCADLHLDSPFKSKSYLSPNIFEDVQKSAYESFKNIVDLALKQEVDFIIIAGDLFDSENRTLRAEVFLNEQFERLRKEQIFVYICHGNHDPLTSKITSQWPNNVSVFSNQVETYQAITKSGETIYIHGFSYQNDASYENKIDAYPSSQGQKGIHIGVLHGTYSKSSVKDRYTEFRLEDLNQRLYHYWALGHIHQREQLSDMPVINYPGNIQGRHFNELGEKGCLLVEGDHLKLTTQFYPTQFIKFEEATIETDHTSKQGLYDVIQSFKDKVRTEGKSFYRLNVRINSEDIIAPQDLIQLKEMITEFEENENQFVFIEDLNLQYVQNDEMPIVKEFSPELLDDASLFDSAMTDLYLNPRASKFLDDYNEFDKVELVNHAERLLKDEMRGEQNDN

SEQ ID NO: 3811 - protein, 330 aa, Staphylococcus epidermidis
RSYQLMKLMNKIIVPVTASALLLGACGSNATESKDNTLISSKAGDVKVADVMKKMGKEQIANTSFSIVLNKVLADKYKDKVDTKDIDKDIKKEEKQYGGKDQFESMLKQQGMSLDDYKEQKKLSAYQKQLLLDKVNVSDKEIKENSKKTSHILIKVKSKSSDKEGLSDKKAKEKAEKIQKEVEKNPNKFGEIAKKESMDSSSAKKDGSLGYVIKGQMVDSFEKALFKLKEGEVSKVVKTDYGYHIIKADKETDFNSEKSNIKQKLIEEKVQKKPKLLTDAYKELLKEYKVDYKDRDIKKAIEDSILDPDKIKQQQQQQSQGGSGLTNSGS

SEQ ID NO: 3812 - protein, 200 aa, Staphylococcus epidermidis
IIRNEYSHREEAYIMFLCTRQIDIHARFGIQRIAFLSLVATIFTFLVSYEVMYYFLDTPLSDRHFFVLIVFILLMYPIHKIVHLLFFLPYYKSFKIHKLSSKKWVPYFNTYVNTPVHKIYFCINLILPIFFLSGIFIMLSIYLPQYGHYFMFLLSLNIGCSMMDILYLKILLFSNDGHYVEEHQSGLHILNKVDNPYIQH

SEQ ID NO: 3813 - protein, 211 aa, Staphylococcus epidermidis
RSILMHKVILVDDHYIVRQGLEFLLSTVDDLSVLKGFKDGATFLSYLKNNERPDIVLLDLVMPEMNGIEITEILKQQYPEIKVLVLTSYVDDEHVISAIDKGADGYEMKDVEPQKLIETIHKVLQGERIIHPQAKSVIKAVSKKPHYTNKLSKREKEVLKEMVKGKTNKEIARALFVSEKTVKTHVSHIFSKLEVSDRTQAAIYAMENKLI

SEQ ID NO: 3814 - protein, 983 aa, Staphylococcus epidermidis
EVNKMIIKSLEIYGYGQFVQRKIEFNRQFTEIFGENEAGKSTIQAFIHSILFGFPTKKSKEPRLEPRLGNQYGGKLSLIFDDGIEAEVERIKGSAHGDVKIYLKDGTIRDEVWLNKKLNYISKKTYQGIFSFDVLGLQDIHKNLDEEQLQDYLLEAGALGSTEFTSMRDRIGQKKEELYKKSGKNPIINQQIEQLKQLENQIRNEESKLDTYHRLVDDKDKSSRRLENLKQNLNQLSKMHEQKQKEVALHDQTQEWKRLEQSLNIEPINFPEKGIDRYETAKSHKQSLERDKSLREERLSILNKEAESINPVDQKYIDSFNSLYQQETEIKQKEFELRSIEKDIADKQRELEALQSNIGWQEVFYDADSTEAMKSHMSDLVLGKQEQIAYINQLERGLEENKIERNSNSNEINQVENELVPDETFEKKKEYTQQVLELHEKENLYEKLKETFEEEQTQKNKRQKFLRIGFIVLTILSAALSIFSFFTANLIFGIIFALLTVIFVVGIIFSRSKAVDYSTAISQEINDLENQLTQLEKEYNLDFDLEYQQQVREQWRHAKKNKKILEEKHQYINQSLTTANERLDSLKHSIIEIKKELRLSEKLSDELVVESISTIGQIKAHDKYIIDLNQQRNNLLKDINHFYERAQSVTEPHLKLFNQMSFFHDVKQWLKNAEEQNEAWNKNQTETQLLNNELKQLKSRLSETNQMIKQLFDYVDVDNEEDYYTHHHHFETYQSDLNRFNDLNQYLENQNYTYEMSSQLSEKTTAQLEEEDHRLAKQVDDYNDQFLEMQAEVSDLNAQINHMETDRTLAQLRHEYYSLKNRLNDIAKDWASLSYMQALVEEHIKQIKDKRLPQVINEAVSIFKNLTNGTYNMIHYTENHKIHVKHSNGQVFEPVELSQSTKELLYVALRISLIKVLKPYYPFPVIVDDAFVHFDKYRKERMLKYLRELSEHYQILYFTCTKDHVIPAKEVLTLNKLQEGGKK

SEQ ID NO: 3815 - protein, 330 aa, Staphylococcus epidermidis
NKGKIGVIKRKGTNGHEDKKISSLNRLPEAILSVKSGKVTGVVVEKPVGEAYLKQNSELTFSKIKFNEEKKQTCIAVPKNSPVLLDKLNQTIDNVKEKNLIDQYMTKAAEDMQDDGNFISKYGSFFIKGIKNTILISLVGVVLGSILGSFIALLKISKIRPLQWIASIYIEFLRGTPMLVQVFIVFFGTTAALGLDISALICGTIALVINSSAYIAEIIKAGINAVDKGQTEAARSLGLNYRQTMQSVVMPQAIKKILPALGNEFVTLIKESSIVSTIGVSEIMFNAQVVQGISFDPFTPLLVAALLYFLLTFALTRVMNFIEGRMSASD

SEQ ID NO: 3816 - protein, 86 aa, Staphylococcus epidermidis
GFSNMFCGVPDSTTTPSAINTTLSLISLAKFISCVTITIVILSFANCLITFKTSPTTSGSSADVGSSNNITSGSIAKALAIATLCF

SEQ ID NO: 3817 - protein, 134 aa, Staphylococcus epidermidis
MLRKYWIHFVIVTVIVSLISIKGFPLALGALYLPLLFKIVQLQLNLSKGLIDNVNVHTFIKSNQSGVVISVICCLLITGVLTYTLDDFYNELPGFLGVLVSISPVTLTIGVILFVLTAIAIVQATKAKYQQSKN

SEQ ID NO: 3818 - protein, 60 aa, Staphylococcus epidermidis
MMANKKDSKLNYHEEENAMVTDLDDLKELGKEMEQISQENDEEKLNQSHDNEVRSDLKKQ

SEQ ID NO: 3819 - protein, 326 aa, Staphylococcus epidermidis
IPNLTSLIQIKDLKGRFLLMTKTIGLLVMAYGTPYKESDIEPYYTDIRRGKKPTEEELQDLKDRYEFIGGLSPLAGTTDRQAEALLEALNKEQDDVNFKLYLGLKHISPYIEEAVEQMHNDGIKEAVTVVLAPHYSSFSVGSYDQRAQEKADEYGIQLTHIKHYYQQPKFIKYWTEKINETLEQIPNQEHDETVLVVSAHSLPKGLIERNNDPYPHELHETAEILKQESNIIHVAEGWQSEGNTGTPWLGPDVQDLTRDLYKEHQFKHFIYTPVGFVCEHLEVLYDNDYECKVVCDDIGVNYYRPEMPNTHPLFIGAIVDEIQSHI

SEQ ID NO: 3820 - protein, 388 aa, Staphylococcus epidermidis
NSICNFKKVAKLMNNKLKKEIIDFAHSIGIDSIGFTTADPFDELKQKLEEYHAKGYASGFEESNISLRTEPKLSLPSARSIIAIAVGYPNKLKGAPKSVKGDRRGMFARASWGQDYHSIMRKRLDKLADFIKEKVPDVEIQSMVDTGVLSDRAVAERAGLGFTGRNGFVISPELGTWSYLGEMLVSIPFEPDDPLLDSCGDCTICVDRCPTGALVGNGQLNSQKCISFLTQTKGYLQDEYRYKIGNRLYGCDTCQQVCPKNRGINTQHDDIVLEPEILKPRLVPLLQMSNKKFKSTYGHLAGAWRGKKPIQRNAIIALAHFKEESAIPELKEVALNDPRPMIRGTAYWAIGQILEDDAISFIDEHYENEIEEVQLEMKKGLQMRREQK

SEQ ID NO: 3821 - protein, 461 aa, Staphylococcus epidermidis
MSVRIEHDTFGEIEVPEDKYWGAQTERSKRNFPVGKEHMPIQVIYGFAQLKRGAALANHELGKLSDEKKNAIVYACDRILNGELDNHFPLVIWQTGSGTQSNMNVNEVVSYVANEYLKKHGSKETIHPNDDVNKSQSSNDTFPTAMHVALFHEVETKLEPALNHLRQTFKEKEDQYQSIIKIGRTHLQDATPIKLGQEISGWRYMLEKCEQLLSESKKHILNLAIGGTAVGTGINAHPEFGHKVAKYISQNTGYAFVSSENKFHALTSHDEIVQLHGTLKALATDLMKIANDIRWLASGPRAGLAEISIPENEPGSSIMPGKVNPTQCEMLTMVAVQVMGNDTTVGIASSQGNFELNVFKPVIMHNTLQSIYLLADGMNTFNKNCAIGIQPIEENINNYLNQSLMLVTALNPHIGYEKAAQIAKKAHKEGLTLKESAIESGYVTESQFEEWIKPEDMVDPH

SEQ ID NO: 3822 - protein, 77 aa, Staphylococcus epidermidis
NICSIFCYFFTIIKYFKIHCHVNYTPLSLLFYLSRFNLKYTLCINYQTIIFYWLTINITFLGFILHLLYLLALIMKG

SEQ ID NO: 3823 - protein, 320 aa, Staphylococcus epidermidis
ITGRREKMRNVEKLNPGDSVDHFFLIHRATQGVTAQGKDYMTLFLQDKSGDIEAKLWTATKDDMQTLKPETIVHVKGDIINYRGRKQMKIHQIRLAQAEDKVSTKDFVDGAPMSPTEIQEELSHFMLDIENANLQRITRHLIKKYQDRFFTYPAASSHHHNFASGLSYHVLTMLRIAKSVCDIYPLLNRSLLYSAIILHDLGKVRELSGPVATTYTVEGNLLGHISIASDEVAETAKELGIDGEEVMLLRHMILAHHGKMEFGSPKLPHLKEAEILYFIDNIDAKMNMFDKAFKKTEKGQFTERIFGLENRQFYNPTTLD

SEQ ID NO: 3824 - protein, 231 aa, Staphylococcus epidermidis
SQWRCLMTVKVEHLTGGYGKKPVIKDLNFELEKGEIVGLIGLNGAGKSTTIKHMLGLINPMEGKLSISNIKINEDIENYRRKLSYIPESPVIYDELTLEEHIEMTAMAYQLSREEVMRRAKPLLKVFRLENELKVFPSHFSKGMKQKVMIICAFIVDPELYIIDEPFLGLDPLGIQSMLDLMVEKRNENRTVLMSTHILATAERYCDRFIILDKGEIVAFGNLDELRNKQD

SEQ ID NO: 3825 - protein, 199 aa, Staphylococcus epidermidis
SVFIYNRINKGVRGKMTDIIIVHSKHGNSKNHWYEWLRHNLTLEGYDVSLFNLEANDHAQIDEWVNEMKQQLHIRKKDTYFVTHGFGSIAALKFLEETHHHIEGFFSIAGFKEDAQDIDEDVDLKGVTIDYDKIKEQVDKFYGLTSKDDQYVSYKETQRLMNSLNGHTRVVEDGGHFLEEEGFVTFTSLINRMQGYMTR

SEQ ID NO: 3826 - protein, 485 aa, Staphylococcus epidermidis
SRYMAYFNKFLSNSERKRGKVSKKVAIIGAGITGLSSAYFIKKQDPSIEVTIFEASNRVGGKIQTYRSDGYTIELGPESYLGRKTIMTDVAKDIGLENDLITNTTGQSYIFAKNKLYPIPGGSIMGIPTDIKPFIKTRLISPIGKLRAGLDLFKKPIEIEDDISVGSFFRQRLGNEVLENLIEPLMGGIYGTDIDQLSLMSTFPNFKEKEEQFGSLIKGMKDEKEQRIKKRQLYPGAPKGQFKQFRHGLSSFIEALVKDIESKGVHIRYNTPVKDILISQKDYEILLEDDSKEKFNGLLVTTPHQVFLNWFSHDPAFDYFKNMDSTTVATVVLAFDEKNITNTYDGTGFVIARTSQTDITACTWTSKKWPFTTPEGKVLIRAYIGKPGDTVVDDHTDEEIVSIVRKDLSQMMTISGNPDFTIVNRLPKSMPQYHVGHIKMIKEIQQHIKTTYPRLRVTGAPFEAVGLPDCIQQGKNAVDEILEEL

SEQ ID NO: 3827 - protein, 157 aa, Staphylococcus epidermidis
INSIDRQSFTDLIQTKFKMVRIEAGYTQDTMAQTIGLSKKTLVQIEKERVLPNWTTCVSICALFRDSDVLNSTFGCDPLEIVQTISRNHCAYPNHSTTSDIYWNTIDTRNGFILQSNKVSNIYRVLNNEKQPIFGTSKMREAETYFNRNAKEELIHV

SEQ ID NO: 3828 - protein, 146 aa, Staphylococcus epidermidis
RSVIIMSETIFSKIISGEIPSFKIYENDYVYAFLDISQVSKGHTLLVPKKPSANIFETDEETMKHIGVALPKVANAIKNAFHPDGLNIIQNNGEYADQSVFHIHFHLIPRYENDIDGFGYKWETHEDVIDDETKQKIATQIQAQIS

SEQ ID NO: 3829 - protein, 371 aa, Staphylococcus epidermidis
HLSILKYLIKCNMLSLVRMIQLWGDSRVRSKNDTILKAIKGESTSHTPVWFMRQAGRSQPEYRKLKEKYSLFEITHQPELCAYVTHLPVDNYQTDAAVLYKDIMTPLKPIGVDVEIKSGIGPVISNPIQTVKDVERLSQIDPKRDVPYVLDTIKLLTEEKLNVPLIGFTGAPFTLASYMIEGGPSKNYNFTKAMMYRDEETWFALMNHLVDISIDYVVAQVEAGAEIIQIFDSWVGALNVKDYRYYIKPAMNKLISGIKAYYDVPIILFGVGASHLINEWNDLPIDVLGLDWRTTIKQADKMGVNKAIQGNLDPSVLLAPWDVIESRLKDILNQGLNRGKHIFNLGHGVFPEVKPETLRKVTEFVHNYTAK

SEQ ID NO: 3830 - protein, 380 aa, Staphylococcus epidermidis
GDKMEKPTRLALLKEIAEFLNEETEIYSMMQGALRLLINGSDFSTGWIFYIDEEGHHDLVSSVDLPEALSKNHCYYLTNGSCWCVQAYQNHKLTKASNIINCSRINLANHAYDKETNHITHHATVPLQSGSERFGLLNVASPNKEHYSEEDLELLESVAFQIGSAIKRIQLTNKEKENAKINERNRLARDLHDSVNQMLFSLKLTAHAAKGITTDEQAQRAFKTIEETSQNAVNEMRALIWQLKPVGLEQGLIHALHYYSKMLGLDLKVTINGLIDLSNDIEENVYRIIQEAMNNVIKHAKTNKVYLDLSQNVDYLEVDIRDNGQGFDTQSINTFLFNGLKNIKQRTQYLNGKVTIESKINQGTRIYIKIPLKLKEHPYA

SEQ ID NO: 3831 - protein, 277 aa, Staphylococcus epidermidis
EEKMKFTIPKQFNDYTLREIFQYLKLPKKDLHQLNMSKEILINKEYGTLLNNVKTGDHVEIPTPNEVSNYLPSYRYAQIYYEDDDLAIVMKPKGVKTHPNDLKESNTLMNHVIYTVDSEYVEPIHRLDQETVGLLIVAKNPLMKKILDRMLEYNEITRIYKANVKALLPIKPQTIDMPIGKDKFHSNKRRISNTGQRAITHIINSKMIKEGVCQLDIKLDTGRTHQIRVHLAEIGHPVIGDPLYGTSTLRQLELNSHQIEFTHPLTQEIISVSLDDK

SEQ ID NO: 3832 - protein, 242 aa, Staphylococcus epidermidis
VPVINIKNLNKKFGANEVLRDINLTVEKGEVVAIIGPSGSGKSTLLRCMNLLDVPSKGKVIFEDNELTQHNVHLDNLRQKMGMVFQNFNLFPHKKVIENVMLAPLLLHKDSKDQLKEKALYLLEKVGLKDKADSYPNQLSGGQKQRVAIARALAMEPDVMLFDEPTSALDPEVVGDVLKVMRQLANESMTMVIVTHEMNFAKEISDKVVFMADGVVVESGTPQNIFENPQHSRTENFLSRVL

SEQ ID NO: 3833 - protein, 204 aa, Staphylococcus epidermidis
RSVVNMAMNFKVFDNSEKVAEYTADILRKQFNNNPTTIAGFHLSKEHAPVFDELKKNVENHTVDFSQINILDYDDNHSYYEALGVPTGQIYSISYENDAIDFISDKIKTKENKGKLTMQVLTIDENGKLDISVRQGLMEAREIFLVITGANKRDMVEKLYRENGKTSFEPSDLKAHRMVNVILDKEAAAGLPEDVKEYFTARFA

SEQ ID NO: 3834 - protein, 121 aa, Staphylococcus epidermidis
LKGVQRLMAVNLYDYANQLEQALRDSDEYKAIKDAFAKVKENEESKKLFDEFRETQMSFQQKQMQGEEIPEEDLQKAQEQAQAIEKDENISELMNAEQKMSQVFQEINQIIVKPLDEIYAD

SEQ ID NO: 3835 - protein, 148 aa, Staphylococcus epidermidis
SCIFLVILGMKYYYNYPTNKVRRIIMKVSRILFGLGVGAVAGFAVALRHRDNQSVKNHTIDASQPTGAQSELQREIENMKQSFNDILNYGSQIKNESIEFGSSIGEEFKGLIGNFKSDINPNIEKLQSHIENLQNRGEDISNNLSNDK

SEQ ID NO: 3836 - protein, 61 aa, Staphylococcus epidermidis
DLISVELYYCTLENKKGASFNETPFCYSVLGGIRTPDRWLRRPLLYPAELPGHFQHKNYYI

SEQ ID NO: 3837 - protein, 60 aa, Staphylococcus epidermidis
INDSNRFIHTSSPLFLQLPYIVSQYHITVDIYVYSSCKVIFLSLFYNHQKMTKARLPWSL

SEQ ID NO: 3838 - protein, 457 aa, Staphylococcus epidermidis
VYGLECIKLLNYTELENKNVLVVGLAKSGYEAAKLLLKLGANVKVNDGKDLSQDAHAKDLESMGIEVISGSHPFSLLDDDPIIVKNPGIPYTVSIIKEAANRGLKILTEVELSYLISEAPIIAVTGTNGKTTVTSLIGDMFQKSVLTGRLSGNIGYVASKVAQEVKSDEYLITELSSFQLLGIEEYKPHIAIITNIYSAHLDYHETLENYQNAKKQIYKNQTKDDYLICNYHQRHLIESENLEAKTFYFSTQQEVDGIYIKDGFIVFNGIRIINTKDLVLPGEHNLENILAAVLASIIAGVPVKAIVDSLVTFSGIDHRLQYIGTNRTNKYYNDSKATNTLATQFALNSFDQPIIWLCGGLDRGNEFDELIPYMENVRVMVVFGETQDKFAKLGNSQGKYVIKATDVEDAVDKIQDIVEPNDVVLLSPACASWDQYHTFEERGEKFIDRFRAHLPSY

SEQ ID NO: 3839 - protein, 68 aa, Staphylococcus epidermidis
NMSPSSKVYNSIVSEYISFSKSIMMYSLKLIYPLKINQICISFISAILILKRMIIVLKTEKIFNNYFI

SEQ ID NO: 3840 - protein, 802 aa, Staphylococcus epidermidis
TIMLISNEWLKDYVNVDQSVQALAERITRTGIEVDDIIDYTKDIKKLVVGHVLSKTPHPDADKLNICQVDLGEEEPVQIVCGAPNVDEGQHVIVAKVGGRLPGGIKIKRAKLRGERSEGMICSLQEIGISSHVTPKNYESGIYVFPEAVKPGTDALEAIYLNDQVMEFDLTPNRADALSMVGTAYEVAALYQTKMNKPQLTSNESQESAKDELTIEVKNEDKVPYYSTRVVHDVTIGPSPVWMQFRLIKAGIRPINNVVDISNYVLLEYGQPLHMFDQEQIGSQSIEVRQAKKDETMRTLDGEERRLLDTDIVITNGKDPIALGGVMGGDFSEVTEQTRHVVVEGAIFDPVSIRHTSRRLNLRSESSSRFEKGIATEFVDEAVDRACYLLERYASGTVLKDRVSHGDLGSFVTPIEITADKVNRTIGFNLTDEEIIDIFEQLGFDTENKNGEITVNVPSRRKDISIKEDLIEEVARIYGYDEIPSTLPVFKDVTSGELTDRQFKTRTVKETLEGAGLDQAITYSLVSKNHATDFALQNRPTIELLMPMSEAHSTLRQSLLPHLIDAVSYNVARKNTNVKLYEIGRVFFGNGEGELPDEVEYLSGILTGDFVNNTWQGKKESVDFYLTKGVVERIAEKLNLQFDFRAGQIDGLHPGRTAIVSLNGKDIGFIGELHPTLAANNDLKRTYVFELNYDAMMEVSVGYINYEPIPRFPGVTRDIALEVNHEVTSSELLSIIHENGEDILNDTLVFDVYEGEHLEKGKKSIAIRLSYLDTENTLTDERVNAVHDKILEALKKHGAIIR

SEQ ID NO: 3841 - protein, 62 aa, Staphylococcus epidermidis
RIKTYPIVLELLTHLGVLIMKLFNAFKDILEAAITNDGTQLGASIVNIIESSVDMVNRFLGN

SEQ ID NO: 3842 - protein, 155 aa, Staphylococcus epidermidis
NKETKGDNVMGEVKHLQINYKTDELFADFREFGNKNLYMIEELKGQMIDASSDSPFYGIFVGNKLVARMALLDKGEVEETYFPNSNDYILLWKLEVLDTYQRRGYAKQLLNFAKENKKPIKAIARNNSKEFFLKQGFKDVETKNPEGHDILIWNP

SEQ ID NO: 3843 - protein, 631 aa, Staphylococcus epidermidis
INIYKININKDWGITLSNCSSFILFSLINLIMERRSPLEEYQKKIKEKLNVVPLEPGCYLMKDRNDQVIYVGKAKRLRNRLRSYFTGAHDAKTTRLVGEIRNFEFIVTSSETESLLLELNLIKQYQPRYNILLKDDKSYPFIKITKEKHPRLLVTRTVKKNSGKYFGPYPNAYSAQETKKLLDRIYPFRKCDNMPDKLCLYYHIGQCMGPCVYDVDLEKYAQMTKEITDFLNGEDKTILHHLEDRMNKASEQLDFEQAKEYRDMIQHIHNLTKKQKIMSSDNTIRDVFGYSVSKGWMCVQVFFVRQGNMIKRDATMIPLQQTEEEEFYTFIGQFYSLNQHLLPKEVHVPKNLDKDIIQSVVDTKIVQPVRGAKKDMINLANHNAEVQLDNKFELIARDESRTIKAIEELGERMGIQTPIRIEAFDNSNIQGVDPVSAMVTFVDGKPHKKDYRKYKIKTVEGPDDYKSMREVVRRRYTRVLNEGLPLPDLIIVDGGKGHMNGVMDVLENELGLDIPVAGLQKNDKHQTSELLYGASAEIVPLKKNSQAFYLLHRIQDEVHRFAITFHRQTRQKTGLKSVLDDIDGIGTKRKTSLLRTFGSIKKMKEASFDELRQAGLPEKVAKNLQNALQNK

SEQ ID NO: 3844 - protein, 541 aa, Staphylococcus epidermidis
RSKYMKCNTLKLTEQDQFINKIKNSESQITSFYEYDAAKKESFYRRLKTPNNGREFHLSRVIKSYMNELKLTHQQLNNIDALADGAKVVIGGQQAGLFGGPLYTFHKIFSIITLSRQLSEEYDTPIVPVFWIAGEDHDFEEVNHTYAFNNKETTLKKVKYHTMTPPDSNVSRYTPDKNELKASLNHFFKEMKETVHTQDVYQMCVNIINQFDSWTDIFKGLIHEVFKDYGILLIDAQYPELRQMEKPLFKEILEKRNQVDQSFRETQIRTTQQQLPSMIQTETNTHLFIHEDGMRQLLNFDGTYFKLNKTEKRYTKQNLLDIIEREPERISNNVVTRPVVEEWLFNTVAFIGGPSEIKYWAELKGVFDTLNVEMPIVMPRLRITYLYARTKKLLKQYNLSIESVIANGVEQERQRFVREKASNNFINEVEEMKIQQQELYNNLFTYVENNHDNQLLLEKNNQIHLNQYDYLIKRYLLNIERENDISMRQFREISETLHPMGGLQERVWNPLQIMNDFGIDVFSPSTYPPLSYSFDHLIINP

SEQ ID NO: 3845 - protein, 233 aa, Staphylococcus epidermidis
IGDLNMKFKNILFDFDDTLVDFYDAEKKAFYNLAQKYNHQPTQQDFEHFKKVNQAHWEAFQQNKLTKDEVLSQRFINYFNDYQIHVNGKEADKCFRAELAMAPVKLFDHTLEVIQQLKLNHSLYIVTNGVTETQLRRIAQTQFNEIFQDVFISEKAGFQKPMTEFFDFVFEHIGENNRNQTLIVGDSLTSDILGGKNANISTCWFNIRQKENHTSIQPDYIINDLSEMIRIVE

SEQ ID NO: 3846 - protein, 311 aa, Staphylococcus epidermidis
MFHHVSVMLNETIDYLNIKEDGVYVDCTLGGAGHALYLLNQLNDKGRLIAIDQDLTAIENAKEVLKEHLHKVTFVHNNFRELTNILNELEIEKVDGIYYDLGVSSPQLDVPERGFSYHNDAKLDMRMDQTQSLSAYEVVNQWSYEALVRIFFRYGEEKFSKQIARRIEAHREQQPIETTLELVDVIKEGIPAKARRKGGHPAKRVFQAIRIAVNDELSAFEDSVEQAIECVKVGGRISVITFHSLEDRLCKQIFQEFEKGPDVPRGLPVIPEAYTPKLKRVNRKPITATDDDLNENNRARSAKLRVAEILK

SEQ ID NO: 3847 - protein, 252 aa, Staphylococcus epidermidis
RWRHILMEQITSAQNSKIKNANKLKKKRERDKTGLALIEGIHLIEEAYQSQIEVIQLFIVDSDRMSSSIIDYAKEVYQINLKVAEALSGTVTPQGFFAIIKKPTYDKTLAKQVLLIDRIQDPGNLGTLIRTADAAGLDLIVMEKGTADPFQDKVIRASQGSIFHIPVIFDDINNYIHQFNGPVYGTALENAVSFNDVEAQVNFALILGNEGEGVNPDLLKETTQNLTIPIYGKAESLNVAIAGSILMYQLKG

SEQ ID NO: 3848 - protein, 99 aa, Staphylococcus epidermidis
NHFNPRSGEISMGEFKNRINVTINDQHFTIIGEDSPEHIRYVAHLVDEKMQELGQKSAGLDTTRKAILTSVNIMHEKVILEEENRRLQQEINQLKQRDE

SEQ ID NO: 3849 - protein, 281 aa, Staphylococcus epidermidis
VMANQSLKETPKTQSNPQTQVQGQNQQPKQKTVKLIIKRQDNSESKPYEESFEIPYKENLNVIACLMEIRRNPVNSKGEKTTPVTWDMNCLEEVCGACSMVINGRARQSCSAIVDQLEQPIRLEPMSTFPVIRDLQVDRSRMFDNLKRMKAWIPIDGTYDLGPGPRMPEKKRQTAYELSKCMTCGVCLEVCPNVTKNNKFVGAQAISQVRLFDLHPTGSMTKDERLDALMSAGGLQECGNSQNCVNACPKGIPLTTSIAAMNRETSFHMFKSFFGSDHQVD

SEQ ID NO: 3850 - protein, 173 aa, Staphylococcus epidermidis
RVNNMSKWIILSDNHKETGILYHIYELHKDADKFLHLGDSEFSYNDTELSLYQRVKGNCDFYPEFLEEEITEENGIRAFYTHGHLYQVNQTRMKLAEKAKELGCLFAFYGHTHVAKYEQIGGIHVINPGSISQSRSQIEETFAELVYKEDENTIILNFRNRENQIIETVKIEF

SEQ ID NO: 3851 - protein, 334 aa, Staphylococcus epidermidis
KELKLESEEKEIYMIFIYAIIALLITFILVPILIPTLKRMKFGQSIREEGPQSHMKKTGTPTMGGLTFLISIIITSIIAIIFVDHSNPIILLLFVTIGFGLIGFIDDYIIVVKKNNQGLTSKQKFLAQIIIAVIFFVLSDVFHLVHFTTDLHIPFVNFDIPLSFAYVIFIVFWQVGFSNAVNLTDGLDGLATGLSIIGFAMYAVMSYMLDSPAIGIFCIIMIFALLGFLPYNLNPAKVFMGDTGSLALGGIFATISIMLNQELSLILIGFVFVVETLSVMLQVASYKLTKKRIFKMSPIHHHFELSGWGEWKVVTVFWTVGLITGLIGLWIGVH

SEQ ID NO: 3852 - protein, 318 aa, Staphylococcus epidermidis
KSTKKERIQLMGNVVYKLTSKEIQSLMAQTTFETTKLPQGMKARTRYQNTVINIYSSGKVMFQGKNADQLASQLLPDKQSTTGKHTSSNTTSIQYNRFHCIGSDEAGSGDYFGPLTVCAAYVSQSHIKILKELGVDDSKKLNDTKIVDLAEQLITFIPHSLLTLDNVKYNERQSIGWSQVKMKAVLHNEAIKNVLQKIEQDQLDYIVIDQFAKREVYQHYALSALPFPDKTKFETKGESKSLAIAAASIISRYAFVKHMDHISKKLHMEIPKGASNKVDLIAAKVIQKYDIQQLDTISKKHFKNRDKAIHLMNQKYNK

SEQ ID NO: 3853 - protein, 269 aa, Staphylococcus epidermidis
RSMNKPIGVIDSGVGGLTVAKEIMRQLPNETIYYLGDIARCPYGPRPGEEVKKFTTELAQKLMEFDIKMLVIACNTATAVALNYLQNILPIPVIGVIEPGARTAIMTTKNQNVLVLGTEGTIKSEAYRTHIKKINPNVNVYSVACPGFVPLVEQMRYKDPTITNIVIHQTLKQWRNSDADTVILGCTHYPLLYQPIYEYFSGTKTVISSGLETAREVSALLTFSNEHASYTEHPQHRFFATGDTTHIKNIIDEWLNMKVEVQRITVDDS

SEQ ID NO: 3854 - protein, 173 aa, Staphylococcus epidermidis
MLIDIVVLLIICYFIVIGFRRGIWLSILHFASSIVSLYIASQHYQSIAQRLVVFVPFPKTVAFDMVYTIPYDHLQYRFEKVIAFIIIFGMCKLILYLVVVTFDNIITYKKIHLVSRISSVVLSIISVFIYLQIGLYLLSLYPHSFIQYQLSQSLVSRVVIEQIPYLSQFILNL

SEQ ID NO: 3855 - protein, 608 aa, Staphylococcus epidermidis
FISEIKSRALDLNIQGSDISMAEKKIIVVGGGLAGLMSTIKAAEQGAHVDLFSIVPVKRSHSVCAQGGINGAVNTKGEGDSPWIHFDDTVYGGDFLANQPPVKAMADAAPKIIHLLDRMGVMFNRTKEGLLDFRRFGGTLHHRTAFAGATTGQQLLYALDEQVRSFEVDGLVTKYEGWEFLGIVKDEEDAARGIVAQNMTTSEIQSFGSDAVIMATGGPGIIFGKTTNSMINTGSAASIVYQQGAIYANGEFIQIHPTAIPGDDKLRLMSESARGEGGRIWTYKDGKPWYFLEEKYPDYGNLVPRDIATREIFDVCINQKLGINGENMVYLDLSHKDPHELDVKLGGIIEIYEKFTGDDPRKVPMKIFPAVHYSMGGLYVDYDQMTNIKGLFAAGECDFSQHGGNRLGANSLLSAIYGGTVAGPNAIKYVENVEKSYTDLDDSIFEARVKEEKERFDHLLNMRGTENAYKLHRELGEIMTANVTVVRENEKLLETDKKIQELMKRYEDIDMEDTQTWSNQAVFFTRQLWNMLVLARVITIGAYNRNESRGAHYKPEFPERNDEEWLKTTMARYKGRSEKPEFTYEPVDVSLIPPRKRDYTSKSKGGNK

SEQ ID NO: 3856 - protein, 465 aa, Staphylococcus epidermidis
MLMEENKNQPNKENMSNKDDNATHLNDSHRNEDLELFRRNKNARQRRRRRIDNQSKEKDATSTQSQLETKPMDKFIDNHKSHNQNKEIKSDLIEENVNDENDNQKNINDKLNDRIVQETNESRQSTEDDEEFPLDHRSEQQPKASRHSKKHKLLSKFTSKKEKETSTSFNSNEKVTQIKPLSLEEKRAIRRKKQKRIQYTIITLLILIIVLILLYMVTPLSKISNVNVKGNNNVSTSKIKKELNVTSRSRMYTFSKNKAIRNLKQNPLIKEVDIHKQLPNTLTVNVTEYQIVGLEKNKDKYVPIIEDGKELTEYKDEVSHDGPIIDGFKGDKKTRIIKALSEMSPKVRNLIAEVSYAPTKNKQSRIKIFTKDNMQVIGDITTIADKMQYYPQMSQSLSRDDSGELKTNGYIDLSVGASFIPYQGSSTVQSGTEQNVTKSTQEENDAKEELQNVLNKINKQSKENN

SEQ ID NO: 3857 - protein, 591 aa, Staphylococcus epidermidis
HEVRTNSNVNVMSWSSFYGVILMTKKDVIQLLEKIAIYMELKGENTFKVSAYRKAAQSLEVDERTLEEIDDVTELKGIGKGVGEVINEFKTQGQSSTLQTLQDEVPEGLVPLLKIQGLGSKKIAKLYHELQITDKETLQQACEEGKVSTLKGFAKKTEQNILEAVKSIGAKKDRYPIELMRGLNQEIVKFIEQLEGVEQYSTAGSFRRYKEMSKDLDFIISTSEPKKVQQQLLRIPNKVKDVAVGDTKISLELAYDDETIGVDFRLIEPAAFYHTLQHFTGSKDHNIRIRQLAKARDEKVSEYGIEQQDGKLLQLQSEEAIYHHFGVDWIAPAMREDGSEFDKDLSQIIQLDDINGDLHMHTTYSDGAFSIKEMIEANIEKGYEFMVITDHSQSLKVAHGLQVDRLLRQNEEIKQLNEEYKEIDIYSGTEMDILPDGTLDYDDEVLAQLDYVIAAIHQNFNQSEDEIMKRLETACRNPYVRHIAHPTGRIIGRRKGYKANIEKLMNLAEETNTILEINANPHRLDLNAEIVRKYPKVKLTINTDAHHTNHLDFMKYGVATAQKGFVNKERVINTMTKEAFRSFVETNKYKK

SEQ ID NO: 3858 - protein, 390 aa, Staphylococcus epidermidis
FVRRCLSMEEHYYVSIDIGSSSVKTIVGEKFHNGINVIGTGQTYTSGIKNGLIDDFDIARQAIKDTIKKASIASGVDIKDVFLKLPIIGTEVYDESNEIEFYEDTEIDGTHIESVLEGIRDKNDVPETEVINVFPIRFVVDKDNEVSDPKELIARHSLKVDAGVIAIQKSILINMIKCVEACGVDVLDVYSDAYNYGSILTPTEKELGACVIDIGEDLTQVAFYERGELVDAESIEMAGRDITDDIAQGLNTTYDTAEKVKHQYGHAFYDSASDQDVFSVDQVDSDEHVQYTQKDLSDFIEQRVEDIFFEVFDVLQELGLTKVNGGFVVTGGSANLLGVKELLQDMVSEKVRIHTPSQMGIRKPEFSSAISTISSSIAFDELLDYVTISY

SEQ ID NO: 3859 - protein, 111 aa, Staphylococcus epidermidis
KLRRIGIMAIVKVTDSDFDSKIESGVKLVDFWATWCGPCKMIAPVLEELAGDYDGKADILKLDVDENPSTAAKYEVMSIPTLIVFKDGEPVDKVVGFQLKENLAEVLDKHL

SEQ ID NO: 3860 - protein, 202 aa, Staphylococcus epidermidis
FIEGENDMEDIVIATNNQGKINDFKAIFKNQHVIGISELIEDFDVEETGATFEENARLKSEAAAHALNKRVIADDSGLEVFALNGEPGVYSARYAGLGKNDEDNIEKLLTNLEDVQDRRAQFVCVISMSAPNEKTKTFKGTVSGVITTERHGKNGFGYDPIFFVPELNKTMAEITNDEKGKISHRGNAIRLLKEYLEGEQHV

SEQ ID NO: 3861 - protein, 62 aa, Staphylococcus epidermidis
INKGVLIFRKNLRKYANLSKECTVIGVSNRIEIWDRETWNDFYDESEESFEDIAEDLIDFDF

SEQ ID NO: 3862 - protein, 361 aa, Staphylococcus epidermidis
RDYIRRNSVMTQNDLMSELKQQALVDINEAKDAQALQEVKVKYLGKKGSVSGLMKNMKDLPNEDKPAYGQKVNELRQTIQSELDERQKLIKEEKLNQQLSEETIDVTLPSRHIEIGSKHPLTRTVEEIEDLFLGLGYEIVDGYEVEQDYYNFEALNLPKSHPARDMQDSFYITEEILMRTHTSPVQARTMEKRKGQGPVKIICPGKVYRRDSDDATHSHQFTQIEGLVVDKDIKMSDLKGTLELVAKKLFGADREIRLRPSYFPFTEPSVEVDVSCFKCKGQGCNVCKHTGWIEILGAGMVHPNVLEMAGFDSKEYSGFAFGMGPDRIAMLKYGIEDIRHFYTNDVRFLDQFKAVEDRGEQ

SEQ ID NO: 3863 - protein, 101 aa, Staphylococcus epidermidis
KMFMGEFDHQLDTKGRMIIPSKFRYDLNERFIITRGLDKCLFGYTLEEWQQIEEKMKTLPMTKKDARKFMRMFSSGAVEVELDKQGRINIPQKFKEICQFK

SEQ ID NO: 3864 - protein, 98 aa, Staphylococcus epidermidis
FSIIFNICFCFIIISIYFSIFICTASITLFSILIVLFSITLLRILIIIIILCTLICLIPVLTISWCIILIWIRGCFSVLIWSRSRFNRSTGLISCSRC

SEQ ID NO: 3865 - protein, 571 aa, Staphylococcus epidermidis
DNYIQRRDYIMKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQDTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGSAPNQDAEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 3866 - protein, 785 aa, Staphylococcus epidermidis
RDCMRQKTLDVLEFEKIKSFVADETISDLGREKVQEMAPASNFDTVEFQMNETDEISQIYNKHRLPSLSGLAKVSPLVHRASIGGVLNVGELNRIKRLVQVQNQFKTFYNQMLEEDEEVKYPILHDKMNHLPILTDLFKEINEKCDAHDLFDHASYTLQSIRSKISRTNQRIRQNLDRIVKNQGNQKKLSDAIVTVRNDRNVIPVKAEYRQDFNGIVHDQSASGQTLYIEPNSVVEMNNQISRLRNDEAVERERILTELTGLVSAESDALLVAESVMGQIDFLIAKARYARTIKGTKPTFKEDRTIYLPNAFHPLLDKDTVVANTIEFIDDVETVIITGPNTGGKTVTLKTLGLIIVMAQSGLLIPTLDGSQLSIFENVYCDIGDEQSIEQSLSTFSSHMKNIVEILQDADQNSLILFDELGAGTDPSEGAALAMSILDYVRRLGSLVMATTHYPELKAYSYNREGVMNANVEFDVDTLSPTYKLLMGVPGRSNAFDISKKLGLSLNIINKAKTMIGTDEQEINAMIESLEHNSKRVDQQRIELDRLVREAQETHDALSKQYQQYQNYEKSLMEEAKEKANQRVKSATKEADEILKELRNLRDHKGAEVKEHELIDKKKQLDDQYEAKSIKQHVQKKKYDTIHAGDEVKVLSYGQKGEVLELVGNEEAVVQMGIIKMKLPIEDLEKTKKKKEKPTKMVTRQNRQTIKTELDLRGYRYEEALNELDQYLDQAVLSNYEQVYIIHGKGTGALQKGVQQHLKKHKSVRQFRGGMPSEGGFGVTVAELK

SEQ ID NO: 3867 - protein, 61 aa, Staphylococcus epidermidis
GGLIMAVPKRRTSKTRKNKRRTHFKISVPGMTECPNCGEYKLSHRVCKNCGSYNGEEVVSK

SEQ ID NO: 3868 - protein, 778 aa, Staphylococcus epidermidis
CVIMAKRKIKIKKNKIGAVLLVGLFGLLFFILVLRFSYVMITGHSNGQDLIMKANEKYLVKNSQQPERGKIYDRNGKVLAEDVERYKLVAVVDKKASKESKKPRHVVDKKKTAKKLAEIIDMDADEIEKRLNNKKAFQIEFGQKGTNLTYQEKEKIEKMKLPGIALYPETERFYPNGNFASHLIGMAQKDPDTGELNGALGVEKIFNSYLNGSRGALKYIHDIWGYIAPNTKKEQQPKRGDDVHLTIDSNIQVFVEEALDDMVERYAPKDLFAVVMDAKTGEILAYSQRPTFNPETGKDFGKKWANDLYQNTYEPGSTFKTYGLAAAIQEGKFKPDEKYKSGHRNIMGSEISDWNKTGWGRIPMSLGFTYSSNTLMMHLQDLVGADKMKSWYERFGFGKKTGGMFDGEAAGNIGWANELQQKTSAFGQSTTVTPAQMIQAQSAFFNKGNMLKPWFVSSIDNPITKKNYYSGKKEFAGKPVTEETANKVEEELDKVVNSKKSHAMNYRVKGYDIEGKTGTAQVADSNGGGYVKGENPYFVSFIGDAPKKKPKVIVYAGMSLAQKNDQEAYEMGVSKAFKPIMENTLKYLNVGKSSDTSSKTDFSKVPNVQGDEVQKAEDSVNAQSLKPITIGNGKQIKQQSVKSGTKVLPHSKVMLMTDGELTMPDMTGWTKEDVLAFEDLTKIKVSTKGNGFVTNQSISKGQIIKNKDKIEVSLSAEDTDDDQEKTDEDSSDNKSKKDKADEDHSNTSSSTKNDKSNADSKNDSDDSTNETSGSERNN

SEQ ID NO: 3869 - protein, 137 aa, Staphylococcus epidermidis
GVSVMAVEKIYQPYDEATQTSIPQRQPQSSPEKQTVKRKVVVQLTRFEKILYIALITVIALISIYMLSLKMDAYDTRGKIADLDQKIEKQSSENSALKSEIKKNSSYERIYDKAKKQGMSLENDNVKVVRNNGEAKN

SEQ ID NO: 3870 - protein, 216 aa, Staphylococcus epidermidis
QFKLYVSQGGLFLAQSKNEFYLRRLHSLLGVIPIGAFLIVHLMVNHQATQGAEAFNRASGFMESLPFLIVMEFILIYIPLLYHGLFGLHIAFTAKENIGHYSLFRNWMFFFQRVSGILAFVFIAMHLWQTRLQKAFYGKSVDYNLMHETLQHPLWAIFYIICVIAVVFHFANGLWSFCVTWGFLQSKKSQRVFTWISLIVFLVISYIGVAAVIAFI

SEQ ID NO: 3871 - protein, 78 aa, Staphylococcus epidermidis
GGISMVHELGTVGMVCPFPLIEAQKKMNQLNQGDELKIDFDCTQATEALPNWAAENGYPVTNYEQLDDASWTITIQKA

SEQ ID NO: 3872 - protein, 75 aa, Staphylococcus epidermidis
EEWLAFGKIRMEAPVNGGRKYNGPKVAKFLVGKVRTRTKGVTIWALSQREIGEIIVPVKMQVTRDRTERPRGALL

SEQ ID NO: 3873 - protein, 154 aa, Staphylococcus epidermidis
KLITIHNLNEMDKFAQILVKHLSAKDLILLNGDLGAGKTTLTQFIGKALGVKRTINSPTFNIIKSYKGSSIRLHHMDCYRLEGEEDDLGFDEYFEDNAIIVIEWSKFIKDFLPPNHLTINISVKNANERQVSIETHGQHYALVKEAILNELSSN

SEQ ID NO: 3874 - protein, 82 aa, Staphylococcus epidermidis
NGGLLMERTIHFTLVDQVSTLNRITSAFVRLQCNIDELHVKHSDKEGISNMKLKVNIKDDDTFKIVLKKLSQQVNVLSVKSE

SEQ ID NO: 3875 - protein, 97 aa, Staphylococcus epidermidis; identical to SEQ ID NO: 3072

SEQ ID NO: 3876 - protein, 424 aa, Staphylococcus epidermidis
KTVTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 3877 - protein, 112 aa, Staphylococcus epidermidis
VLVAKMTLKKMNIKNQKTLLKGKLTIKKIRKLKKIKNLKKKRNLKKMKIISLHKKIILLIIKKHKILQLKGKNKLNKIINKTMMTNNLTTNQQKMRYMSGINKIYLEVQIMV

SEQ ID NO: 3878 - protein, 173 aa, Staphylococcus epidermidis
MDFLQQNWTNILKIIVSLISIVTFIRVFLYERSRLKVNIIGYDQIEEYLDVYISFSNSSKLPISINEIQIFHKNTMIGEIENFTEKILGQTDGKSIVYSNPMPLNLNSYSSDKDLFRIKLVEELPLNKTLTFKFITTRKNITYKIKDFKLPQYRRSFHRKLKHHKKVSNKNKD

SEQ ID NO: 3879 - protein, 104 aa, Staphylococcus epidermidis
VDIYCNGRLKQMTQEINCNFKSHIPRIMTVPGILLIHENKLEFKAYSQNNNPFNIQFELSSIVRYRTSKGLLGNKLFIYYSDQEWYKFSNLSKSDLNKLTKYLY

SEQ ID NO: 3880 - protein, 106 aa, Staphylococcus epidermidis
FCIYIFWINQTIICTSRYILFIPLIYLIFCWFVVRLLVIIVLLIILLSLFLPLSCRILCFLIISRIIFLCRLIIFIFLRFLFFFRFFIFFSFLIFFIVSFPFSSVF

SEQ ID NO: 3881 - protein, 138 aa, Staphylococcus epidermidis
GVTYKMKKIFILLLSSLLVLAACGKNYEISDITNKFKKEGLSVENLRKMKREDFGMAPMKTENAKIFTVSDDKNARILKFKNEDDLKEMKKYYEELGKSSAAFYSHVYTKDRFLIQMNGDIDDHLFEKYKKAMNEALD

SEQ ID NO: 3882 - protein, 622 aa, Staphylococcus epidermidis
TYQQLNKLLSFYYTRKDSNFRKVLTSKCLSPISSWMGLNNVPIFIGTFFYFLNNYMGERYMRSDMIKKGDHQAPARSLLHATGAFKQPTDMNKPFVAICNSYIDIVPGHVHLRELADIAKEAIREAGAIPFEFNTIGVDDGIAMGHIGMRYSLPSREIIADAAETVINAHWFDGVFYIPNCDKITPGMLLAAVRTNVPAIFCSGGPMKAGLSAQGKALTLSSMFEAVGAFKEGTISKEAFLDMEQNACPTCGSCAGMFTANSMNCLMEVLGLALPYNGTALAVSDQRREMIRQAAFRLVENIKNDIKPRDIITQDAIDDAFALDMAMGGSTNTVLHTLAIANEAGIDYDLERINEIAKKTPYLSKIAPSSSYSMHDVHEAGGVPAIINELMKKDGTLHPDRLTVTGKTLRENNEGKNIKNFEVIHPLENPYDKQGGLSVLFGNLAPKGAVIKVGGVDPSIKVFTGKAICFNSHDEAVEAIDNHTVREGHVVVIRYEGPKGGPGMPEMLAPTSSIVGRGLGKDVALITDGRFSGATRGIAVGHISPEAASGGPIGLIRDGDKITIDLINRTLNVDQSEEELYRRKNQLEPFRAKVKTGYLARYTSLVTSANTGGIMQVPENLI

SEQ ID NO: 3883 - protein, 133 aa, Staphylococcus epidermidis
SSGHYNKLKIISILKRRNNKMSNLEQNIKQMKNEVIEAELNTKINTVITMIGEHMDSNERFKSHLDAQGKVMESYMLKEYYQNYYVLMAVLNSILKDVNFMNDEITTFHDRALDELDKTKASSENFGEESLNA

SEQ ID NO: 3884 - protein, 584 aa, Staphylococcus epidermidis
EMIKMSNQKSMVSPHPSEHQTKESQPLITRSGSQLLVEALQQEDVDFIFGYPGGAVLPLYDTFYDGKIKHILARHEQGATHAAEGYARVSGKTGVVVVTSGPGATNAITGITDAYSDSLPLVVFTGQVATPGIGKDAFQEADLLSMTTPITKHNYQVKKIEDIPRIVHEAFHLANTGRKGPVVIDFPKDMGVLKTDVELTKDINIPGYEVNSSPNKEDINKLIYMIKEAKKPLILAGAGINHSKSNHLLTEFVTRHQIPTVTTLLGLGAVPYHHPLFLGMGGMHGSYASNMALTNCDLLINLGSRFDDRLASKPDAFAPNAKVVHVDIDPSEINKVINTDLGIVADCKHVLENLCHEQVLTSSHEEWNDYCINNKSNYPFKYDENDKTFCKPQKAIEYIGKVTNGNAIVTTDVGQHQMWTAQFYPFKNYGQWVTSGGLGTMGFGIPSAIGAQLAEPEKTVVCFVGDGGFQMTNQEMALLPEYGLNVKIVLINNGTLGMVKQWQDKFFNKRFSHSVFNDQPDFMKMAEAYGIKGFLIDSPDKLESSIDEAFAYHGPALIEVRISPIEPVNPMVPSGKSNHEMEGY

SEQ ID NO: 3885 - protein, 69 aa, Staphylococcus epidermidis
MNNNQFKVIKEIYNTLQKTIEDKSTEYKHKIKDGNNEWIETVNREEHLQALIEWALQQIENNFDFEEEK

SEQ ID NO: 3886 - protein, 189 aa, Staphylococcus epidermidis
LEIKPITIYTGKTVPLFYDNIDTDQIIPKVHLKRVSKSGFGPFAFDEWRYLPDGSDNPDFNPNKPEYHGASILITGDNFGCGSSREHAAWALKDYGFNIIIAGSFSDIFYMNCTKNAMLPICLNQKEREHLAQFDEITVDLPNQTVSTVSQSFHFDIDETWKNKLIHGLDDIAITLQFENLIEKYEKTF

SEQ ID NO: 3887 - protein, 372 aa, Staphylococcus epidermidis
EFAKYGPFYYNTLVFISEKGDKMVWTIISGLVVGILLGFVMQRTRFCLAGGFRDMYVQKSNKMFYALLIAITVQSIGLLILKHLNIIEVPAETFPVIGTILGSFIFGIGIVLAGGCATGTWYRAGEGLIGSWVALIFYALTSAVTKTGVLLPIMNQINKTTQVNTSMTSTTGIPQWILVMLLILITVFLVVKTIRKPKIMVPQLKQKYSGIRHYLFEKRYHPFVAGIAVGFIALLAWPMSESTGRMGGLGITTPSANLVNYLISGDLKFIDWGVFLVLGIFLGSYIAAKGSKEFRWRLPDIKTIRNSAIGGIFMGFGASVAGGCSIGNGLVETATMSWQGWIALASMIIGVWFMSYFIFVQPMKKLQQVTQS

SEQ ID NO: 3888 - protein, 319 aa, Staphylococcus epidermidis
FFMKNISDIAKLAGVSKSTVSRFLNNGSVSPATKEKITKIIEENNYQPNQFAQSLRARRTNLIGAIIPRMNSYAVDETIKGLVHQCNQHRYQLLLNYTGLEIDGEISALKTLSRSKVDGIVLMATHITEAHIEVIEKIDVPVIIVGQKHDRLYSIYHDDYEAGYKIGVLIGEKGCRNVHFFGVSEEDIAVGIQRKLGVIQALKDYHISPKIYETTFKHEQAFKDVSQQLERVHHADAIVGATDTIAFAIHKYCSDHQQRFYNCSIYGFGGDPMTQIVSPVIQTVSYNYFEAGEQALKEINQLLKGEQTALKIKIPIQLN

SEQ ID NO: 3889 - protein, 215 aa, Staphylococcus epidermidis
MNMNIEIIANQFETRAATLLRYYTGLLESSRDNHFAFKIYNDPFDMVYVMMNGKLFGHVYIKDCKVRNSFELASSKHTEGQIRSIEGYYNGFEIHDDKHLSISDMMARQLFEDEYFMYGLETFAESNNTDMFTYIEGGLNVEELEGVQSSNADVIGNIEILYQLATGINEPASELVESLKLVTAFVQDENATQDDYKTLERKLSELKTSYYSVSK

SEQ ID NO: 3890 - protein, 69 aa, Staphylococcus epidermidis
KLMNKVLGYRKMLGKTQQQMAKELNISEQSYRNREKGKINFKKNEMIKFKIMLLEKGLKDITLDDIFFS

SEQ ID NO: 3891 - protein, 649 aa, Staphylococcus epidermidis
KGENRMILLQLNDISKSFDGEDIFTDVNFEVKTGERIGVVGRNGAGKSTLMKIIAGVENYDSGHISKIKNLTMSYLTQQMTLNSEATVFEEMSKPFEHIKKIENLIKDETDWLARNGQDYKSDEYQSHIEKYETLTNRYEQLDGYQYESKIKTVLHGLNFTESDFNKPINDFSGGQKTRLSLAQMLLKEPDLLLLDEPTNHLDMETTKWLEDYLKYFKGAIVIISHDRYFLDKIVTQVYDVALGNVKHYVGNYEQFIKQRNQYYEKRMQEFEKQQEEIKRLETFVEKNITRASTSGMAKSRRKTLEKMERIDKPMIDARSANIQFGFDRNTGNDVMHIHDLKIGYDSPITLPINLEVFKGDHIAIIGPNGVGKTTLIKTIAEKQNKLGGQIIFGANLQIGYYDQKQAEFKSNKTILDYVWDQYPHMNEKDVRAVLGRFLFVQEDVKKIINDLSGGEKARLQLALLMLQRDNVLILDEPTNHLDIDSKEMLEQALKDFEGTIIFVSHDRYFINQLANKVFDLNINGGQMFLGDYQYYIEKTEEAAAIKAHETVTQNNFENKEINQDANTSTYISQKQQKRQQRKLERQIEHCERQIEELEAQISHIEEQLTQPEVFNDPLKASKFANQKSDIEQKLEQIMLEWEKLQEKL

SEQ ID NO: 3892 - protein, 461 aa, Staphylococcus epidermidis
EEEKIMGQTLFDKVWKKHVLHGKEGEPQLLYIDLHLIHEVTSPQAFEGLRIQNRKLRRPDLTFATLDHNVPTIDIFNIKDEIAHKQITTLQQNAKDFGVHIFDMGSDEQGIVHMVGPETGLTQPGKTIVCGDSHTATHGAFGAIAFGIGTSEVEHVFATQTLWQTKPKNLKININGSLPTGVYAKDIILYLINQYGVDFGTGYALEFTGETIKNLSMEARMTICNMAIEAGAKYGLMQPDETTFDYVKGRPYATDFDSSMAWWKKLYSDDDAYFDKVIELDVTNLEPQVTWGTNPEMGVSFSNPFPEIKNANDQRAYDYMGLHPGQKAEDIKLGYVFLGSCTNARLSDLIEASHIIKGQQVHPNITAIVVPGSRTVKKEAEALGLDKLFKDAGFEWREPGCSMCLGMNPDQVPEGVHCASTSNRNFEGRQGKGARTHLVSPAMAAAAAINGKFIDVRKVVV

SEQ ID NO: 3893 - protein, 291 aa, Staphylococcus epidermidis
KLSEIKLEYDTQVSVIWYGTLDSRSFKQFSQPKWSELVNRLSIPQNNTNKYARGVAVYGDMKDDTDENGNEYKKYRKDGNVIYRDVLVLDYDDIPKLRLLHDAITETLKGVSWMYHTTFNHRTESPRIRLYIALSERISADDYRKYTKVLANKIGHLVDEGSFQPSRAMALPVYIKGKHPFLHQYNDAPILNVEMLEKWSKETNIQTDQPSKTNFNKRDDTYWRDISFSVTKGNRNNSLASLIGHLFSRHVNEYIVYSYALLWGQNACNPPLNEREINATFQSILKKHRNK

SEQ ID NO: 3894 - protein, 103 aa, Staphylococcus epidermidis
LMTDAKLRERSVCMPYVNLQNLPTKANVVTEPNQVVVKPIMAKPNVIAKLFGISYSSVNRILKEWEKDSKGIDDLYYSLSSTMTVISISRFEQYMKKRHKDWM

SEQ ID NO: 3895 - protein, 492 aa, Staphylococcus epidermidis
NIVEWTREERYQRIEDVDETYLEQLKHQVDTSLYRQTFHIQPEMGLLNDPNGLIYYNGHYYISHQWFPLGAVHGLKYWFNYKSKDLLHFEPQGTLLKPDTKYDSHGVYSGSAFEYQNHLYYMYTGNHRDQHWNRISSQMIARMNKDGKIEKFPKPVIHGQPEGYTSHFRDPKVFEKNSQLYAILGAQNENEMGRLLLYRSQDVVDWHFEGEIKTNLTQFGYMWECPDYFRLSNKDVILMCPQGVEAEGDKFRNIYQSGYMIGDLNFNNLFFDHESFQELDNGFDFYAPQTFVDADGQRILIGWMGLPDTEYPTDKEGWAHCLTIPRVLTIENGKLKQRPFKQLEDLRTNKETALGYANKFKRKLHPYEGKQYEMIIDILENDASEIYFELRSSRSESTLITYNKHENKLTLDRTDSGTLPSNVDGTTRSTILDSPLKQLQIFVDTSSIEIFCNDGERVLTSRIFPNEDATGIKASTESGQVYLKFTKYELKG

SEQ ID NO: 3896 - protein, 417 aa, Staphylococcus epidermidis
WVALLPFLFRRDKMWHEKFTNKHGDVQYRYYEKYKDPLTNKWRRVSVVLNKNGKQSQKEAQKLLNKRIEAKINDKTPIDLKTLTFHQACDEWLDRYIKTSGSKQSTIKTKKYKIKHIKRNINSDILVKNMNSDVVQKSVDNAVKDNLSHKVVKDAMSIIRNIMKYIQRKYKLTDISYLDDIVIPKKATTREEVKAKRENYLEMDEVKAIVDNLHEIANSKRADYMKRSFIMTAYIMEFQALNGMRIGELLAIQPNNIDFDKKTLEIDGTIHWRNEGNAVGFKDTTKTESSYRTISLTTRSCDILRKVMLENKKAIQWESMYQDRGFIFTNYRGNPMSLSTINRNMQQSANNVGITKHITSHTMRHSHISLLSQLGISLKAIMQRVGHTDHKTTLQIYSHVTDQMDKDMMNKLEKVGN

SEQ ID NO: 3897 - protein, 181 aa, Staphylococcus epidermidis
RRIRMKRLLGTLFAATLVLSACSQDDTKEDEHKKSENTAERKADDKKDKKTKEDKKSKKEKKSQENEDNKSTQEDNSTDNQETQDPATQGQKQTQQDNQQNYDDQQSYHEPTKDEVYEWDKQNIPGGTDYGLIDPEDVNTESEDNARQNRIDEINEEMEDPNISVSDYNKLVDEYNELNNE

SEQ ID NO: 3898 - protein, 68 aa, Staphylococcus epidermidis; identical to SEQ ID NO: 3076

SEQ ID NO: 3899 - protein, 354 aa, Staphylococcus epidermidis
VERRYTYMSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRRTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSEIFKLLKEKYL

SEQ ID NO: 3900 - protein, 321 aa, Staphylococcus epidermidis
FIMRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSTDMLYQPENIDDIQIFQDDILHFCSVDLIESDMKNAHEKMIEKFESVGGTIVFDPNVRLPLWEDKLECQRTINAFIPKAHIVKISDEELLFITGKKNEDEAIQSLFRGQVNVVIYTQGAQGATIYTKDDYRIHHEGYQVQAIDTTGAGDAFIGAIIYCILESRHSECKDLFKEKGKDILAFSNRVAALTTTKHGAIESLPTKEDIKDYY

SEQ ID NO: 3901 - protein, 145 aa, Staphylococcus epidermidis
KLSGDSLGTSTHFEKILKKFWRLHMDKEQLKQHMYDYVKEHKEIPIYQLEDLFKELDHDYKGKASVTNEHDKNIVFWSGWNKLTMYALIELVKGEHLDLIYRASYVMRYLLDGRVPSLPLAITYPEYGQQTEVPSWVPMLLRVTK

SEQ ID NO: 3902 - protein, 282 aa, Staphylococcus epidermidis
FCVGLRKFFVHYNHFRRKMMDIDKLEVGKRIKNIRLNKSKNLREFGELISKNLKEDKNISDSIVSRWEKGVSIPSAKRLKEIADIGNVSVNYLLYGVKVTYKDIHNNINTVSMKNEIMDNLEKFLKYYLLYSEYNNYSIKTAELLDLLFENAGYDITTLTKDLCALVSDKRFSFYQHGVYLLLNEDFSKLHVQLYLSEFIYNLLVQITLDYPNIYIKNLVLQITETKERIKDISHKKDAYTEFEIETHLADFINHKEYKKLLDNLSQLEKKITNDNSLIDNN

SEQ ID NO: 3903 - protein, 546 aa, Staphylococcus epidermidis
KEKGELNFMTNNQTLVLIILTFIILITLVNVIISIIERRKQIAKINTLWDNKLKLESFIRPNSRFDAQYHAYRDHYNEQSFIDDKTWSDLNMDTLFHKINFNFTAIGEMRLYATLRGMFKVNQTSLINKFKDNKVFRLNVSYILSKIGKNVYPLFPDQMLPTKRNILLMFCPLLPFIGVAFIFLIPSKGILICLTFMILNAILSFKLKKSYDQDLKSIFYTANVIKQSQALSKIESTPAISVDFTHFKASRRFSGLLVRVESQDMASSIIMFIKLVFMIDYFLFHLIQRSYFKYQEEVMACYDYISILDNHYSIAMYQHTLTHYCYPKINHNINGLQMKSIIHPLLDEENAIANTIDISNHILLTGSNASGKSTFMKAVALNLILAQSIQTATAHSFIYQPGYVMTSMANADDVLSGDSYFMSELKSIRRLFNTHQCNKIYCFIDEIFKGTNTTERIAASESVLSYLDNQKAYQVIAATHDVELSTLLENTYNNYHFNESIQENSIFFDYKIKPGKANTRNAIELLRITQFPIDIYQRAQQNIRNL

SEQ ID NO: 3904 - protein, 160 aa, Staphylococcus epidermidis
IIRGGTKLVKPTREQLNIRKMSVEDVPKVFDIERNSFSHSSWSIDAFYHEIENNEFATYFVIEFSDKIIGYVGLWLVVDQAQITTIAISKAFRGYGLGQLLLKYAMNYARFSCDVMSLEVRIDNDVAQHVYRNLGFQNGGKRKNYYGEGEDALVMWVNLK

SEQ ID NO: 3905 - protein, 69 aa, Staphylococcus epidermidis
  UNSURE (54),(65): Identity of amino acid at the above locations are unknown.
SSTGSFRPVAGNLHLHRYYDFTDLSLRQCPNRYAFRAGSNFTDKEFRYLRTVIXTAAVYWGFHSXLPKS

SEQ ID NO: 3906 - protein, 575 aa, Staphylococcus epidermidis
VERGKYMELTKDDILHEIEKTKQEKDAIHEVIPKGYEIEQHQNGVALYQIIPSKKDGEPDKKIFITNTIPQITERFEDIESNEVSYNMLFYDNQIPVNLGVSAEEIADSRQLLKLVNRKFDVTSTTSTRLVDYINKSKRHNPPVNIKVATRLGHVKGYFIYPYKEEMKNRNIKLFNNDKGFQKLIDSFQSKGTLESYSEHVFSKIKSLPMVMVMLYASLGSVLLREFELQPFIVEISGSTSTGKTFTLNLVSSVWGTSNLITTWSSTNNSIEAMASFLNSFPMFKDDTRNTHPKFVANATYNFSSGESKSRSNINLTLNAKKEWRNILLSTGEASISNMADEKAGVSARVVTLQDQPYPDNFDFTTLDKAFRDNYGTLGKVFIKQYQSKQESYKNAFESYQRYFNQKGSNEIMQRLGHAFALLQVSGEILNDIEGFEHDHFKIIEQAYNSMVRNNKTIDKPKQLLEELLQYLDANRNNIAGEGYSSVKNGDIKAIYKRDYLCILGETVKEKLRYEMQTITGQWDKKGYLIKGEKDRLQKQVKHETVKYRGFAIRQEVLEELGFDFSNSYNPNSDY

SEQ ID NO: 3907 - protein, 437 aa, Staphylococcus epidermidis
PYLILLFKKTLIMMFLKEVVSMNMNDTIFLFLCTLLVWLMTPGLSLFYGGLVQSKNALNTVMQSMVAIVIVTFVWIIIGFSLSFDGGNQWIGGLKFLGLHHVGFETSKTLSPHIPLSLFMLFQMMFCTIAVSILSGSIAEKMRFIPYLIFVSLWVLLIYSPVAHWVWGGGWISKIGAIDYAGGTVVHITSGVSGLVLGIMIGIGKKKEKHTPHNLLITLIGGILVWLGWYGFNVGSAFTFDHIAMISFVNTVIGASAGAFGWLIFEYILKKTTSLLGLLSGALSGLVAITPAAGYVSYMSAMIIAIIGGICCYIVINLIKVKLQYNDALDAFGIHGVGGILGAVLTGVFQSHQINSAVQNGFIYTADFKVVVIQLGAAIATVVFSAIVTFLIARFIKIFTPLATTQEEDKTGLDAIVHGEKAYFYGELNKFNRHIKF

SEQ ID NO: 3908 - protein, 178 aa, Staphylococcus epidermidis
NSRILTESKINKTEITDIVVAKGPGSYTGLRIGVTVAKTLAYALNTNLYGVSSLKALASTVKDSTKLLVPIFDARREAVYAGVYQYQDNELITIIDDTYIPIFELIEKLHQLNQPYVFVGYHTEKIKHLLDSDIVEQLPQASSMKQLIQKPENIHSFTPKYHKLSEAERNWLNQQENN

SEQ ID NO: 3909 - protein, 368 aa, Staphylococcus epidermidis
EFGIPKWWQKKELLWRRRGRISHVGEFEMTNNKLILAIETSCDETSVSVIKNGTELLSNTVLSQIDSHKRFGGVVPEVASRHHVEGITATIDESLVSAKVKMEDIDAIAVTQGPGLIGALLIGINAAKALAFAYDKPIIPVHHIAGHIYANHLEQPLTFPLMSLIVSGGHTELVYMKNHLDFEVIGETRDDAVGEAYDKVARTINLPYPGGPHIDRLAAKGKDVYDFPRVWLEKDSYDFSFSGLKSAVINKLHNLRQKNIEIVAEDVATSFQNSVVEVLTYKAIHACKTYHVNRLIVAGGVASNKGLRTALSEACKKEGIHLTIPSPVLCTDNAAMIGAAGYYLYQAGLRGDLALNGQNNIDIETFSV

SEQ ID NO: 3910 - protein, 249 aa, Staphylococcus epidermidis
VFVVDNYLYYEMTFNICFNSFTDFNDTCIIYAKKGVRYMPDDFKIPRATLKRLPLYYRFVSILKGKGIDRVNSKTISEALQIDSATIRRDFSYFGELGKKGYGYNIDSMLEFFKSELSESDQIKIAIIGIGNLGRALLTYNFSIHDEMTITEAFDIRPDIIGENIGDVVVKHSDDIKMTLESEDIDVVILTTPDNVAQQVADELVKAGVKGILNFTPRRIKTPQDVQVHHIDFGIELQSLLFFMKNYSK

SEQ ID NO: 3911 - protein, 530 aa, Staphylococcus epidermidis
CHSLNLKVLKNNNIRGVFLMEEHIQIFDTTLRDGEQTPGVNFTFDERLKIAKQLEKWGVDVLEAGFPASSTGSFKSVEAIAKTLTTTAVCGLARCKKSDIDAVYEATKEAIKPQVHVFIATSPIHLEHKLKMTQDEVLTSIKEHVSYAKQFFEVVQFSPEDATRTEIPFLIECVQTAINAGATIINIPDTVGFSYPTEYGEIFKQLTQAVKSNSKIIFSAHCHDDLGMAVANSLAAIEGGARRIEGTVNGIGERAGNASLEEVALALYVRKDHYGLESQINLKETKKTSDLISRYAGIRVPRNKAIVGQNAFSHESGIHQDGVLKHRETYEIMTPQLVGVNTTELPLGKLSGKHAFAEKLKALGYEIKLEDQVTLFKQFKEIADKKKNVSDRDIHAIIHGSEHEHNAIFQLDNLQLQYVSKGLQSAVVVIKERNGQVKQDSSIGTGSIVAIYNAVDRIFKKDAELIDYRIDSVTEGTDAQAEVHVRIIINHIEVTGIGIDHDILKASCKAYIDAHAKYISEYELKEGIRT

SEQ ID NO: 3912 - protein, 63 aa, Staphylococcus epidermidis
LFSSIILVIFSFVAGLTDPLFKKRETVLFDTPANFAISDIFFIKNHLSRHQSFFFILPYEPTL

SEQ ID NO: 3913 - protein, 339 aa, Staphylococcus epidermidis
LEEFIMTKVYYDETVTQDALQGKKIAVIGYGSQGHAHAQNLKDNGYDVVIGLRPGRSFNKAKEDGFDVYTVSEATQQADVVMVLLPDEIQGEVYNKEIKPYLEKGNALAFAHGFNIHFSVIEPPSDVDVFLVAPKGPGHLVRRTFVEGSAVPALFGVQQDATGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRIITPNVKENMKKVLEDIQNGNFSRRFVEDNKNGFKEFYQLREDQHGHQIEQVGRELREMMPFIKSKSIEK

SEQ ID NO: 3914 - protein, 109 aa, Staphylococcus epidermidis
DYRSVYKKLLEGRVRKPKVSVSIKSQRINIDDRQVNEPYMKDRHIKDITLREIKNSDGDTIPPGAFFVLNDNNNKHSDSRTYGLIDKKDIIGDVSLKYYPFKEFNYQFK

SEQ ID NO: 3915 - protein, 406 aa, Staphylococcus epidermidis
LLPSFQMEAIDTCPNKYSTIRRVLIMNKKTQMIHGGHTTDNYTGAVTTPIYQTSTYLQDDIGDLRQGYEYSRTANPTRASLESVIANLEHGKHGFAFGSGMAAISAVIMLLDKGDHLVLNSDVYGGTYRALTKVFTRFGIDVDFVDTTKIENIEQYIKPETKMLYVETPSNPLLRVTDIKASAKIAKKYDLISVVDNTFMTPYYQNPLDFGIDIVLHSATKYIGGHSDVVAGLVATADDDLAERLGFISNSTGGVLGPQDSYLLIRGIKTLGLRMEQINRNVEGIVQMLQKHPKVQQVFHPSIKEHMNYTIHQNQATGHTGVVSFEVKDTEAAKQVIHATNYFTLAESLGAVESLISVPALMTHASIPSDVRAKEGITDGLIRLSIGIEDTEDLVNDLEQALNTLR

SEQ ID NO: 3916 - protein, 69 aa, Staphylococcus epidermidis
VAESWYCYFVVQMFELGEESFERHHFLHIQYKLSVGYVIRVVEMSEWFYPLILVFELPVRVTVYLQQLI

SEQ ID NO: 3917 - protein, 273 aa, Staphylococcus epidermidis
KELSTMDPSLILPYLWVLLVLVFLEGLLAADNAIVMAVMVKHLPPKQRKKALFYGLLGAFIFRFIALFLISIIANFWWIQAAGAVYLIYMSIKNLWQFFHQSNEKHHKETGDEHHFDETGNEKEVGPKSFWGTVFKVEFADIAFAIDSMLAALAIAVTLPKVGIHFGGMDLGQFIVMFLGGMIGVILMRFAATWFVELLNKYPGLEGAAFAIVGWVGIKLIIMVLAHPDIGVLPEAFPHSALWQTIFWVVLVGLVLIGWLTSAIGNKKKGNQK

SEQ ID NO: 3918 - protein, 375 aa, Staphylococcus epidermidis
KEFFIQNNKNGYNYLLKYLNDLDHPQLIFESTGIYSRGMERFCCVNQINYIQMNPLEAKFKTSALRSWKTDQADAHKLACLGPTLKQTDNLPIHELIFFELRERVRFHLEIENEQNRLKFQILELLHQTFPGLERLFSSRYSIIALNIAEIFTHPDMVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 3919 - protein, 86 aa, Staphylococcus epidermidis
SFLFITFIITLLMYFFLCQLLYSCFSQIIFNTFLIDFSLMLFSFSLIFLLYFLTSYALFSLYVMKVFTSFTSILTAWYDLFFIVIH

SEQ ID NO: 3920 - protein, 312 aa, Staphylococcus epidermidis
YSLLSSEPKIMIAYDLIGQTPLVLLESFSDENVKIYAKLEQFNPGGSIKDRLGKYLIEKAIDEGRLKEGDTIVEATAGNTGIGLAIASNRHKVKCIIFAPEGFAEEKISIMKALGADVRRTPKAEGMTGAQQEALAYATRYGYLYMNQFETKDNPGAYTQTLAKQLTDELSHIDYFVAGVGSGGTFTGVAQHLKTYDVKNYIVEPEGSVLNGGVSHPHATEGIGSEKWPSFLEKELVDGIFTVADKDAFNNVKLVANKEGLLVGSSSGAALQGALELKKSIQNGVIVTIFPDGSDRYMSKQIFNYKESFNNE

SEQ ID NO: 3921 - protein, 274 aa, Staphylococcus epidermidis
CMDPYKVLIEVMKTESFTRAAENLYTSQPSVSRDIKRLELKYNVKIFEFKSPYLKLTRDGEKLLQYALQRESIEQELWQNLTSESEIISGTLTIGSSYTYGEYLLSEQLTSLMQQYPKLHIHLRVNNSDSVINDIKHNRVDIGIVEKEIQDNAIKCKEIMEDEMVYIYKKSIQPRMDICFVREKGSGTRFYQEVGLSELKLNPYLIEINNIKIIKQMVEAGNGFAIISKSALHPEDYEKLMITTLNVKRHYYLAQHVDKYIGENIRAVIEMIMK

SEQ ID NO: 3922 - protein, 100 aa, Staphylococcus epidermidis; identical to SEQ ID NO: 3071

SEQ ID NO: 3923 - protein, 184 aa, Staphylococcus epidermidis
GAALIMTKQDLSLSVFTNENYKNLHYTSSSFRNSMYDELEVNKSRFKNCNFNEGIFKNIEAICNCKFTTCGFNNCIFEDVHFYKNQFKDSTFVNTPFDQSVFNSTLFQNAMFDSNLIRSVKWTDIIFKNVSFKNVEIEGTTFKDVKFKNCEFKNVIITNSTMSQKLMNELQKQDVTLENIDTSI

SEQ ID NO: 3924 - protein, 274 aa, Staphylococcus epidermidis
YMQPYLICLDLDGTLLNDNKEISPYTKQVLTELQQCGHYVMIATGRPYRASQMYYHELNMSTPVVNFNGAFVHHPKANDFKVIHEVLDVEISKNIITALQQSHITNIIAEVKDYVFINSYDPRLFEGFSMGNPKIQTGNLLENLNEAPTSLLVEAEEENIPEIKDMLTHFYAENIEHRRWGAPFPVIEIVKRGINKARGIKHVQNYLNIADDHIIAFGDEDNDIEMIKFATHGIAMANGLKDLKEIANETKFSNNEDGIGRYLNDFFNLKMRYY

SEQ ID NO: 3925 - protein, 373 aa, Staphylococcus epidermidis
CIRPKNAKIKEVKVMTETVLEVNDLHVSFDIAAGEVQAVRGVDFHLNKGETLAIVGESGSGKSVTTKAITKLFQKDTGRIKKGEILFLGEDLAQKSEKELIQLRGRDISMIFQDPMTSLNPTMQIGKQVMEPLIKHKKLSKAKAKQRALEILNLVGLPRAEKRFKAYPHQFSGGQRQRIVIAIALACEPKILIADEPTTALDVTMQAQILDLMKELQNKIETSIIFITHDLGVVANIADKVAVMYGGQMVETGDVNEIFYDPKHPYTWGLLSSMPDLTTSNDTDLIAIPGTPPDLLHPPIGDAFARRSRYALDIDFKEEPPWFKISPTHFVKSWLLDARAPKVTPPSMVQKRLRTMPSNYEQPHRVERVAFNE

SEQ ID NO: 3926 - protein, 79 aa, Staphylococcus epidermidis
IKKPVNEFMKTHLLSILIGIMSQAHRSVEKPSVLSLILLRGDNNKHTHLFVEFEEFDRANEEKHAKVEYHSSKNKTDTL

SEQ ID NO: 3927 - protein, 410 aa, Staphylococcus epidermidis
LLFTKERVLEMAKIPVTVLSGYLGSGKTTLLNHILKNREGRRIAVIVNDMSEVNIDKDLVAQGGGLSRTDEKLVELSNGCICCTLRDDLLREVERLVHKGGIDQIVIESTGISEPVPVAQTFSYIDEELGIDLTSICRLDTMVTVVDANRFVNDIRSEDLLADRDESVDDEDERTIADLLIDQVEFCDVMIINKIDLISDEALEKLENVLRALQPEAKIIKTVNAKVELSDVLNTQLFDFEKASESAGWIKELTAGGHATHTPETEEYGITSFAYTRRLPFHAKRFHQWLEQMPENIVRTKGIVWLAQYNDVACLLSQAGSSCNIHPVTYWVATMSESQQQAILEARQDVVEDWDIEYGDRQTQFVIIGTDLDQEKISRELDACLIHSSEIDEDWRLLDSPYQWTYDRRM

SEQ ID NO: 3928 - protein, 86 aa, Staphylococcus epidermidis
GGDTLFTKKILIYIALLITLIRFFIPLHPDFDTLLVWLFILYIIPIILCIIGFKSDKLIATMIMIPNLMGIGYRIFIFFNDFLHLK

SEQ ID NO: 3929 - protein, 206 aa, Staphylococcus epidermidis
SRRLIKMKNVSKALIWFVISFIIFHAILFVMWGEHQEYWYLYTGIMLIAGISYVFYQRDIASKRLLTSIGMGIITSVALIIIQLIFSLISSELSYASLIKELSRTGVYFKWQMLVTLLFVIPCHELYMRTVLQKELIKYNLPKWASILIVAICSSSLFIYLDNWWIVFFIFVAQFILSLSYEYTRRIATTTIGQIVAIILLLIFHG

SEQ ID NO: 3930 - protein, 564 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKPSYKTINRFRVNPKVDALLESLFIQFHSQCLKQNLIDDQAIFIDGTKVEANANRYTFVWKKSIQNHESRMNENSKALYHELVINKIIPEIKKDHDNDLTKEEIDLIGSHLDKEIEDLNQHIDNEKCTKIRKQIRLKRTKIKKYKKQINDYSQRKHKYEVQKSILKDRNSYSKTDHDATFMRMKEDHMKNGQLKPGYNLQIATNSQFVLFYDVYQNPTDTRTMIPFLNTIQETYGHLPEYIVADAGYGSEANYMAIIDNFNRTPLITYGMFIKDKTKKYKSDIFNTQNWDYDEINDEFICPNNKRLGFKRYAYRHDKYGFKRDFKLYECDDCSECPLKQQCMNFNSKTNKKIMKNYNWEYFKAQINKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHF

SEQ ID NO: 3931 - protein, 62 aa, Staphylococcus epidermidis
VIQTIKLSYKYIGMLLNKLEKIHNNLLIKIGFLNKFCYISFIMWFILCFTRSNRFMVCKENN

SEQ ID NO: 3932 - protein, 262 aa, Staphylococcus epidermidis
SMSAITILGFLLLLIMVIFGGKKGLISFFTLFLNFIILVISILLIIYGVSIYLVTFIFCFIIAAINLFVLNSYNVKTQAAFLGTLVTILILILMIYFSVEMGHLQGFATEQQDETYVYSMNIGINMVQFMVFTIVLAVIAAVIDLAITISSPMYELNETNPNLNQHQLFQSGMRVGREILATSANTIYLAFFGGQLTLFFWFFKLKYSFGHIINSKIFTQEFIAILLGGIAVAISIPITAWITAFMIKHFSQKKTLTNQQNK

SEQ ID NO: 3933 - protein, 63 aa, Staphylococcus epidermidis
ELHAYILTKIFSPTLNRKYSVHFMYSHNREIIYDFDQFSNRLVLALIIVYSVMSLCPVLTFAF

SEQ ID NO: 3934 - protein, 63 aa, Staphylococcus epidermidis
CQCAKGSCSNNGSNIFFLHLKSSSTLGFVYSRFNNTKILYSLIMYSMFALDDILITNIILNKK

SEQ ID NO: 3935 - protein, 452 aa, Staphylococcus epidermidis
HFSALKGVGNLSGHSQWKTSTGFILASAGSAIGLGAMWKFPYMAGIYGGGAFLLMFLIFTIFVGLPLLIMEFTVGKMGRTYTTQIYKKLTGKKWLNIIGWNGNLAVFILFGFYSVIGGWIIIYIGYVIAQIMVFKSSTLTNIQFETIISNPWLTVLGQGIFILITMVIVMLGVEKGLEKASKIMMPLLFIFLIIVVAQSLTLEGALEGVRYILQPRVEDMSIQGVLFALGQSFFTLSLGTTGMITYASYAPKNMTIKSSALSIVVMNILISVLAGLAIFPALKTFGYQPQEGPGLLFKVLPLVFSEMTFGTFFYFIFLLLFLFAALTSSISLLELNVSNFTKNDNSKRQKVAIIGSILVFIISIPATLSFSSLSHLRFGAGTIFDNMDFIVSNILMPLGALGTTLVVGQLLDKKLLKESFGKDKFNLFLPWYYLIKFIMPIVIILVFIVQLF

SEQ ID NO: 3936 - protein, 267 aa, Staphylococcus epidermidis
KYMAEELRIMENKSREDTNLSPVSKIEIYSFFDPFSKDCFKLSAILSKLRIEYNKYIKIRHILNPSLKVLTKCQAQSTSDFDNIALAYKAAELQGRIRAERFIHLMQNEIIPKRDIITEDMISDCINNAGIDYQVFKEDLQKDKLTDSLKVDLHIAREMEIEQAPSLVFFSENVHEEGLKVEGLYPYHIYTYIINELMGQPIEKNLPPKLEYYIQKKQLVTMEELLTIYEWPEKLLNKELKKLTLQQKVEKLQYPEGEFWKSKMPQC

SEQ ID NO: 3937 - protein, 75 aa, Staphylococcus epidermidis
ALNFVRKGDRFVVESIDRLGRNYDEVIHTVNYLKDKEVQLMITSFPRMDEVIGKPLLYIESHALCVWFRKGFTVI

SEQ ID NO: 3938 - protein, 123 aa, Staphylococcus epidermidis
EALYFGATGVLSYRKFFPFIYNLFQKGYFENSLTIIGSGLNELTTDEFREKVKNAIQNNIENSKEIGAFLKRLFYKQQDANSKDSYQKFLEMSLELDDKFDLKENRLFYLAMSPKFLELQQTT

SEQ ID NO: 3939 - protein, 301 aa, Staphylococcus epidermidis
MKFLSFKHNDRTSYGVKVKREDAVWDLPMVFAEFGDKDFNPKTLIAGLQQNQTLDFQEQVRKAVVAAEESGRDEEFKLLFTDIDFLPPVTPPNNVIAFGRNYEDHASELNHEVDSLYVFTKAASSLTGDEATIPNHKDITEQLDYEGELGIVIGKSGEKIPRGLALDYIYGYTIINDITDRTAQSSHDQAFLSKSLTGACPMGPYIVTKDELPAPENVNIVTKVNNEIRQDGNTGEMILKIDELIEKISKYVALHPGDIIATGTPAGVGAGLQPPQFLQPGDEVKVTIDNIGTLTTYISKN

SEQ ID NO: 3940 - protein, 81 aa, Staphylococcus epidermidis
RASYSVETKYKAVEMKAAEFSTKEIMKELNIRNRTQVKSWWLWYQNEESMFVLYLYPQSLIICLSLHFSTNQCYNLDNEND

SEQ ID NO: 3941 - protein, 199 aa, Staphylococcus epidermidis
NMHYPEPISKLIDSFMKLPGIGPKTAQRLAFHTLDMKEDDVVKFAKALVDVKRELTYCSVCGHITENDPCYICEDKQRDRSVICVVEDDKDVIAMEKMREYKGLYHVLHGSISPMDGIGPEDINIPALVERLKNDEVKELILAMNPNLEGESTAMYISRLVKPIGIKVTRLAQGLSVGGDLEYADEVTLSKAIAGRTEM

SEQ ID NO: 3942 - protein, 270 aa, Staphylococcus epidermidis
IMRYTILTKGDSKSNALKHKMINHMKDFQMVEDSENPEIVISVGGDGTLLQAFHQYSHMLSKVAFVGIHTGHLGFYADWLPHEVEKLIIEINNSEFQVIEYPLLELIVRYNDNGYETRYLALNEATMKTENGSTLVVDVNIRGKHFERFRGDGLCISTPSGSTAYNKALGGALIHPSLEAMQIAEIASINNRVFRTVGSPLVLPKHHTCLITPVNHDTIRTTIDHVSIKHKNVNAIQYRVANEKVRFARFRPFPFWKRVHDSFISSDDER

SEQ ID NO: 3943 - protein, 876 aa, Staphylococcus epidermidis
NPIYRKSSIIFKTILVKEDRIMLQSDINELVNQAKRVITPLSPISTFAARNPWEGLEDASFDQVARWLKSVRDIDIYPNASTIHRAISNKEIDLKVFEERLDENRAHYNNRSLSDSDINTYIQRAKNLKTIEEGYFNTKDNEKLEKWVQTNFKDYKKKEDVIAQSASVFTKEGTRLIDILNAHMIKWSKLYVDDFQSSWTMPKREKGFYHAWQRLVKHDPLFTKKQRLTLTHLPNQATEAIEYAFQELGVKEEHRQSYIESHLLSLPGWAGIMYHRSQTQSNDAYLLTDYVAIRLSIEMVLLNDHHTTLLKKSIYLQKKLEQIRYLLFNIQMNVEQWLNLSSKKQQAYIELGTRFSPFYFKKLWLDAWEETHERRLVDEIYRVPTEDTDQAKAKVQLAFCIDVRSEPFRRHLESEGPFETIGIAGFFGLPIQKEVLDEQFAHPSLPVMVEPAYRIKEYADQHEMKIYNQQQHTLTSMFYNFKLMKNNVLPSLLLPELSGPFLSIATIANTIFPKKAKRIVHRFSQKWLRKPTGKLTIQREQDAYSKLPIGFTLEEQIQFSKKALQLMDLTDDFAPLIVLCGHGSESHNNPYHASLECGACGGASSGFNAKLLAVMCNQENVRRGLLMEGIDIPRHTVFIAAEHQTSVDELEYIYVPPLTTEAQNAFDELKHVMPKVCYKTNLERLASLPNINNTDHNPNAEAHRHASDWSEVRPEWGLARNAEFIIGKRQITQNSNLEGRAFLHNYDWTKDEDGEILNTIISGPALVAQWINLQYYASTVAPHYYGSGSKTTQTVTSGVGVMQGNASDLMYGLPWQSVMMNDKEAYHAPIRLLIVIQAPDAYIQRLLKHHNHFRQKVDHQWIRLASIDENNSWKDW

SEQ ID NO: 3944 - protein, 101 aa, Staphylococcus epidermidis
GYLFVYNRTQCGFVKCVRKWTYYLLSLISSNLGILIYTQPQCGFSNRLNNSIYLLSSNVSVLINNTNADALSQCIRKRKYSFSKIKLNTAEMSALVDISQR

SEQ ID NO: 3945 - protein, 1529 aa, Staphylococcus epidermidis
SNLYIEQINKLHYSNYYQTKLSENSNKGVCIMYNEKLKKGLYDYREEHDACGIGFYANMDNKRSHDIIEKSLEMLRRLDHRGGVGADGITGDGAGIMTEIPYQLFEQLTEFKVPGEGYYAVGLFFSKEKVRDSIHEEMFNQYFESEGFKVIGYRDVPVDTRAIAQHVADTMPYIQQVFVDITGVKEVEKRLFLARKQIEKYSETQSIDLYFTSLSHRTIVYKGWLRSDQIKGLYLDLQNEAYQSKLGLVHSRFSTNTFPSWKRAHPNRMLMHNGEINTIKGNVNWMRARQNKLVETLFEDEKDKVHFIVDEDGSDSSIVDNALEFLSLAMEPEKAAMLLIPEPWLYNESNDKKVRSFYEFYSYLMEPWDGPTMISFCNGDKIGALTDRNGLRPGRYTITKDNFIVFSSEVGVIDVPEENVAFKGQLNPGKLLLVDFLQNKVVENNELKTNIANELPYEQWLKDYKNKNDLDNIYYQSSDWDDQTLFRLQKQFAYTKEDINKYMTDLVINKKDPIGAMGYDAPIAVLNDKPESLFNYFKQLFAQVTNPPIDAYREKIVTSELSYLGSEGNLLCPDESVLERIQLKKPVLNEAQLSSIDHSYFNVTYLSTLYTGDLESSLNELGNRAIQAVHEGAKILVLDDTSLTHENSYAMPILLALSHVHQLLIREGLRMETSLIAQSGETREVHHVACLLGYGANAVVPYLAQRTIEQLTRQGQLSGTVAENVATYTNVLSEGVIKVMAKMGISTVQSYQGAQIFEAVGLSNSVIEKYFTGTQSKLSGISIEQIDKENKARQSDDSDYLESGSVFQWRQQGQHHAFNPRTIFLLQHACRENDYELFKKFSKTVNLKRTDHIRHLLEFKTRQSIDISRVEPASEIVKRFNTGAMSYGSISAEAHETLAQAMNQIGGKSNSGEGGEDSSRYEIQKDGSNKISAIKQVASGRFGVTSDYLQHAKEIQIKVAQGAKPGEGGQLPGSKVYPWIAETRGSTPGIGLISPPPHHDIYSIEDLAQLIHDLKNANRRADIAVKLVSKTGVGTIASGVAKAFADKIVISGYDGGTGASPKTSIQHAGLPWEIGLAETHQTLKLNDLRSRVKLETDGKLLTGKDVAYACALGAEEFGFATAPLVVLGCIMMRVCHNDTCPVGVATQNKDLRALFRGKAQHVVNFMYFIAEELREILASLGLETVEELVGRTDLLQRSTQLKPNSKAASLQIERLIEQFDGVNTKEISQNHHLDEGFDLNYLYPDARYSIENGHSFTGNYVVNNEQRDVGVITGSAIAKQYGEEGLPEDTILAYTEGHAGQSLAAYAPRGLTIHHTGDANDYVGKGLSGGTVIVNAPNSQRENEIIAGNVNFYGASRGKAFINGKAGERFCIRNSGADVVVEGIGDHGLEYMTGGHVIILGDVGKNFGQGMSGGVSYIFPSDVEKFKKVNALETLEFSSIRFDEEKSLIKDMLEAHFKHTRSNKARQLLDQFDNIEKLAIKVIPKDYKLMMQKIDLKKRQMEREDEATLAAFYDDRETIEQELQPAVIY

SEQ ID NO: 3946 - protein, 333 aa, Staphylococcus epidermidis
KHEYVKLIPGIKNFLRRCTTMNVGIKGFGAYAPKNIIDNAYFEQFLETSDEWISKMTGIKERHWADEDQDTSDLAYNASIKAIEDAGIQPVDIDMIIVATATGDMPFPSVANILQERLGTGKVATMDQLAACSGFMYSMITAKQYIQSGDYKHILVVGADKLSKITDMTDRSTAVLFGDGAGAVVMGEVAEGRGIISYEMGSDGSGGKYLYLDRETGKLKMNGREVFKFAVRIMGDASTRVVEKAGLSSEDIDLFVPHQANIRIMESARERLGIEREKMSVSVNKYGNTSAASIPLSINQELQNGKIKDDDTLVLVGFGGGLTWGAIVIKWGK

SEQ ID NO: 3947 - protein, 180 aa, Staphylococcus epidermidis
NGGYMHIYLSTLTEVDYETSLNSIENNYNLNPESSWQDRARVKNLRKLESYNYELEVIAKNELNEVIGHVVLAEVKLSSKNKKAIALAIGALSVDKSIRNQGLGQALLKAVEERAKEQGYCAIFVNNHPQYFEKSDYEAAHLYNIHIEEKRNHQSLLVKFLKPVQNEWSGMTVYYPEVLD

SEQ ID NO: 3948 - protein, 503 aa, Staphylococcus epidermidis
DGGYAMLSSELILFMFFITLVIAILSGLIFLNHRVPIQYIKFHIYLLVLPIITGLSGLIFFGERANVGPFVVDHLTWLMMTFILTLGFIIQKFSMRYLIGDMHYRKYFPFFTLITAFASLAWLSGDLRLMTMFWGATLFVLTRLIKVNKLWKVPREAARISAWSFILAWLSLLIAVILLYIATGDWYIYSNMSDDNAINYGMRLCINLLIVLAVIIPAAQFPFQGWLIESVAAPTPVSAIMHAGIVNAGGVILTRFSPVFNDEIAISLLLIIASISVLSGSGITLVHVDYKRQLVRSTISQMGFMLVQCALGAYSAAIVHLILHGVFKATLFLQSGSVVKRFNIPTSPSVKKSYGWLVFGRLLAILIAIIFWLNSDRHAYDVLSALILAWSLMVSWNQLVAFSHGLIGRVIGVCMIIVVAIVYIITHHYFFTTLSNVDIHIVSPPLISIILSIAIIVFGSMLSIWVSRRRESKAFAKLYLWLIKVGEAKTQSIESHPSYLKRF

SEQ ID NO: 3949 - protein, 412 aa, Staphylococcus epidermidis
VTHLNRMKSMERFLCMQDSSSSNYSSNRNFVMMLVILFLMEFARGMYILSYINFLPTVTSIAIAITSFAFSIHFIADAATNFVIGFLLKKFGSKLVLTSGFLLAFISLFLVIWFPASPFIIIFSAIMLGIAVSPIWVIMLSSVDERNRGKQMGYVYFSWLLGLLVGMVIMNLLIKFHPTRFAFLMALVVLIAWVLYYFVNINLTNYNTKPVKAQLKQIVDVTQRHLILFPGILLQGAAIAALVPILPKYATQVVKVSTVGYTVAIIIGGIGCAFSMLFLSKIIDNNSKGFMYGVIFSGFILYTILIFGLSTITNIYIVWAIGLFIGLMYGILLPAWNTFMAGHINPNEQEETWGVFNSVQGFGSMIGPLVGGLITQFTNNLNNTFYFSAMIFLALAVFYGYYFIKTNRRVKP

SEQ ID NO: 3950 - protein, 70 aa, Staphylococcus epidermidis
RDNLYGYLYFLRSNKNKLHTPSFPTSEVQKQPLKPMPKGFHYSMLLFPLDDMYFSHVFSTIDIRCHIRVL

SEQ ID NO: 3951 - protein, 102 aa, Staphylococcus epidermidis
LLIHLINNDIERKDKMKKCSISSLSSIIVTLISIFICFTTMFTNIYNNTDFNFWYFPGAIIFVISIIINIIAMFKGNKTLNIILFFINFFALLIFTTPFAIV

SEQ ID NO: 3952 - protein, 391 aa, Staphylococcus epidermidis
MVTQNKKILIITGSFGNGHMQVTQSIVNQLNEMNLNHLSVIQHDLFMEAHPIMTSICKKWYINSFKYFRNTYKRFYYSRPNELDKCFYKYYGLNKLINLLIKEKPDLILLTFPTPVMSVLTEQFNINIPIATVMTDYRMHKNWITPYSQRYYVATKDTKDDFIEAGVPASYIKVTGIPIADKFEESIDKEEWLSQQHLDPSKPTILMSAGAFGVSKGFDYMINNILEKSPNSQVVMICGRSKELKRSLKAKFKDNPSVIILGYTNHMNEWMASSQLMITKPGGITISEGLSRCIPMIFLNPAPGQELENAYYFESKGFGKIADTPNEAIDIVSDLTNNEETLKVMSSKMLESKVGYSTRKICKDLLDLIGHSSQPDEIYGKVPLYARFFVK

SEQ ID NO: 3953 - protein, 397 aa, Staphylococcus epidermidis
FFSHHGYNDIIQYFIYCFDLYCRHFIWCYRSKNSCTRGQEIMSNKEDVTNINGDISNATMSHTSNDISNTDFIIRDLDLNQEPEMPRQSKNFWQDAWSQLKRNKLAVIGMIGLLLIVIMAFIGPLMNKHDFAEQNVDHRNLPAKIPLLDHVSFLPFDGKGTDGKNAYKEAGAKENYWFGTDQLGRDLWTRTWKGAQISLYIGVVAALLDICIGVVYGAVSGFFGGRVDDVMQRILEIIASIPNLIVVILFVLIFEPSIWTIILAMSITGWLGMSRVVRGEFLKLKNQEFVLASQTLGASKFKLIFKHILPNTLGAIVVTSMFTVPSAIFFEAFLSFIGIGVPAPKTSLGSLVNDGRAMLLIHPHELFIPAIILSLLILFFYLFSDGLRDAFDPKMRK

SEQ ID NO: 3954 - protein, 180 aa, Staphylococcus epidermidis
RRIHMKKLLCTLFAAALVLSACGQDDTKEDENKKSEITTEKKSDDKKDKKTNEDKKSGEQKKSQEKKNNKSMQESATNEQVQSQQQTQQANQQAQQSDNHEPTKEEIYEWDKQNIPGGTDFGLIDPEDVNEASESQNEEPDEWIKGQEEWNNATQSEKEELRKQNAQKYGYEYDPKDYEE

SEQ ID NO: 3955 - protein, 576 aa, Staphylococcus epidermidis
VIVNGGATVDYQALYRMYRPQSFDDVVGQTHVTKTLRNAISKGKQSHAYIFSGPRGTGKTSIAKVFAKAINCLNSDDGEPCNECAICKGITQGTNNDVIEIDAASNNGVDEIRNIRDKVKYAPSESKYKVYIIDEVHMLTTGAFNALLKTLEEPPAHAIFILATTEPHKIPPTIISRAQRFDFKAISSDQIIDRLKYVANSQSLDYDDAALEFIAKASEGGMRDALSIMDQAIAFGDERLTLQDALNVTGSVDEAALNELFNDIVKSDVKAAFNRYHHFISEGKEVNRLINDMIYFVRDTIMNKTSNESVHFESLIHFDLDMLYRMIDIINDTLVSIRFSVNQSVHFEVLLVKLAEMIKTQPQTVQNVATASVANEPDNEMLLQRLEQLENELKTLKEQGIKTNKVSQQPKKPTRTIQRSKNTFSMQQIAKVLDKANKDDIKLLKNHWQEVIDHAKSNDKKSLVSLLLNSEPVAASEDHVLVKFDEEIHCEIVNKDDEKRNNIESVVCNIVNKTVKVVGVPADQWLRVRAEYLQNRNTNETHQSEKQSTQQSQQIDIAQKAKDLFGEETVHLVDED

SEQ ID NO: 3956 - protein, 93 aa, Staphylococcus epidermidis
FMTKQANASRLSRLFNVAGFIVDGYNGIRYNAKNKQLVYLSLGLSALGTIIDFYISIKSASKLRKLSALGSFAINGVRLFTSFKKVRDEYDYH

SEQ ID NO: 3957 - protein, 415 aa, Staphylococcus epidermidis
RMNKNNRVVITGIGALSPIGNDAKTTWDNALKGVNGIDKITRIDTDDYNVHLAGELKDFNIEDHIDRKEARRMDRFTQYAVVAAREAVKDAQLNINEKNADRIGVWIGSGIGGMETFEVAHTTLVERGPRRVSPFFVPMLIPDMATGQVSIDLGAKGPNGSTVTACATGTNSIGEAFKIIQRGDADAMVTGGTEAPITHMAIAGFSASRALSTNNDPETACRPFQEGRDGFVMGEGAGIVVLESLDSAKERGAEIYAEVVGYGSSGDAHHITAPAPEGEGGSRAMQAALDDAGIKAQDVQYLNAHGTSTPVGDLYEVQAIKNTFGDAAKSLKVSSTKSMTGHLLGATGGIEAIFSALSIRDSKVAPTIHAITPDEECDLDIVLNVAQDLDITYAMSNSLGFGGHNAVLVFKKFED

SEQ ID NO: 3958 - protein, 132 aa, Staphylococcus epidermidis
LSCNSIIAFYWRFVGYLIYWCKENFKEVILMEEALKDSILGALEMVIDPELGIDIVNLGLVYKVDVDDEGLCTVEMTLTSMGCPLGPQIIEQVKSVLAEIPEISDTEVMIVWSPPWNKDMMSRYAKIALGIG

SEQ ID NO: 3959 - protein, 69 aa, Staphylococcus epidermidis
GCINNIARPSLTRDPNDVLGAGTPIPIKLKNASKNIALGTVNIDVTTIAPNVLGNICLKINLNLEAPNV

SEQ ID NO: 3960 - protein, 347 aa, Staphylococcus epidermidis
RYNNNVLRFHIEVKVHMKSITQASFMKGIMFTFTIAIISYILAKFPILHTIGALAIAIIFAMIYRQVIGYPEHIRPGITFASKRLLKFAIILYGLKLNMGDILGKGWKLLLIDIIVIIFSISLTLLLNQIIKGNKDISILLGIGTGVCGAAAIAATAPILKSKEKDIAISVGIIALVGTIFALIYTAIEAIFNIPTITYGAWTGISLHEIAQVVLAAGIGGSEAMTFALLGKLGRVFLLIPLSIVLILYMRYKSHSSQVQQKIDIPYFLIGFIIMACINTFVPIPSLLMNIINVITTLCMLMAMVALGLNIVLKEVISKALKPFIVICITSICLSGVTLLVTSIMFK

SEQ ID NO: 3961 - protein, 73 aa, Staphylococcus epidermidis
RINKWRLYNMRYLMTFIWAVLLLQMVNFVLNSLNSGPELNVINPIIIAVIFTIVVAILDPILKPSKGSNQYES

SEQ ID NO: 3962 - protein, 104 aa, Staphylococcus epidermidis
SGNNRSIIYLKEGSQKLMIINRGPIVDIDNQKYIFDYSACNYPVGVVEDQIYYFNEDNIDKVVFEGYSDQDEMRFQELFKEMKNNLDDDIQQGIVQKQDNLGLI

SEQ ID NO: 3963 - protein, 143 aa, Staphylococcus epidermidis
KVVKKGVTYKMKKFFIFLLSSLLVLAACGKNYEISDITSKFKKEGLSVENLRKMDREDFGMAPMKTENAKIFTVSEDKNARILKFKNEDDLKEMKKYYEELGKSSATFYSHVYTKDKFLIQMNGDIDDHVFEKYKKAMNEALN

SEQ ID NO: 3964 - protein, 60 aa, Staphylococcus epidermidis
YYQNFTSIEIELRNMMLIFKPYLLIIDKFLNPRIHCRRYIFTVIDIEPFHVSNFMIGFNF

SEQ ID NO: 3965 - protein, 85 aa, Staphylococcus epidermidis
VFKNHVQRENINYENEDIDHSKKHLNYDLINDGKQNFNDLIDEKIERNYTGKRKIRKDAVKHIDGMITSDNEFFSNQTPVNTKFF

SEQ ID NO: 3966 - protein, 130 aa, Staphylococcus epidermidis
SLKNPMQFYYSNCEQNASNLLVINVQPNEGFSLCVNGKKSNQNNEMQKVKLSYTMPIKDKMNTVDAYENLIYDTLIGEQTNFTHWEELKILGNLLMILKMYGNKNSHSFLIMPLDAMGLKKVKNYLVKTD

SEQ ID NO: 3967 - protein, 192 aa, Staphylococcus epidermidis
TLKKEILEWIVAIAVAIALIAIITKFVGKSYSIKGDSMDPTLKDGERVVVNIIGYKLGGVEKGNVIVFHANKKDDYVKRVIGTPGDSVEYKNDTLYVNGKKQSEPYLNYNEKRKQTEYITGSFKTKNLPNANPQSNVIPKGKYLVLGDNREVSKDSRSFGLIDKDQIVGKVSLRYWPFSEFKSNFNPNNTKN

SEQ ID NO: 3968 - protein, 518 aa, Staphylococcus epidermidis
HLMNGTCYTKFKERSGSMEKNENKIVDVIATSDMHSHFLNGDYGSNIYRAGTYVNEARKNNENVILLDSGGSLAGSLAAFYYAVVAPYKRHPMIKLMNAMQYDASGISPNEFKFGLSFLTRSVALSRFPWLSANIEYTVTREPYFSTPYTIKMYSDLKIAIVGLTSDGLMKNEYAEMEEDVCIEKTLVSAKRWIRYIHEVEEPDFLIVIYHGGLNKISSANKRNEKNANEAEKIMEELGVIDVIITAHQHQTVVGKDHGTIYVQAGQNAEELVHLSIKFKKRTTSYEIEHIDSKVIDLNDYHEDEQLLKETYYDRKAVKHWANSVVSNKNNGLTVQCIEDIICKPHPFTQLLHDAIRLAYNYDISCVHIPKNGEEGLKGTIRNRDIYDAYPHPDKPIDITVKGKNIKDILEYSYAHIDFNKRQLSMTMIDETLFTVWQGFDYCIDMSQSPFNRVKLNGLNEEDSYRITMTDYCYRNYKMYLQEAIVHDTYSETMGGLIRKNLKCDMYSVKLNHNFKVY

SEQ ID NO: 3969 - protein, 213 aa, Staphylococcus epidermidis
NKMNQWDQFLTPYKQAVDELKVKLKGLRKQYEVGEHNSPIEFVTGRVKPISSVIDKANKRGIPFDCLHEEMYDIAGLRIMCQFVDDIDIVVDILRQRQDFKVIEERDYIRNTKASGYRSYHVIIKYPIETLSGQKHILAEIQIRTLAMNFWATIEHTLRYKYDGAYPDEIQHRLERAAEAAYLLDEEMSEIKDEIQEAQKYYTQKRAKKHEND

SEQ ID NO: 3970 - protein, 248 aa, Staphylococcus epidermidis
IGVNVKMKVKSPQSIYLKGHRQQAVLLLHSFTGTVRDVKHLAQQLNEEGFTCYVPSYPGHGLPLKEFTQHNINDWWEQVTAAYQFLRNEGYSRINVTGVSLGGLFTLRLAEHFDLERIAVMSAPHKKRESEIAWRLERYGHRMNEILSLSEEERRHQMETILSYDKEIEVFQGVIDEIMAYLANITVPVNIMYGEEDDPLYAQSAQYIYDNVNSQDKELLKFEKSGHLMTYGDHAYRVEQSIIQFFSK

SEQ ID NO: 3971 - protein, 121 aa, Staphylococcus epidermidis
IKKNIYNNVIALLFDWFVIFSSILISVTFNNILIYLVAIILIGSRMRAFDNLMHEACHRSLFTNKFWNKWITCLFVAFPVFTSYTAYRNAHHCTGFFKTTLPGFYSVVKDIFTPNYERKES

SEQ ID NO: 3972 - protein, 381 aa, Staphylococcus epidermidis
LSFDIYLLSMKKNKIGGSQSMFNKVWFRTGIFFIMLFILIKLFMEVHEVFAPIATIIGSVFLPFLISGFLFYICLPFQNILEKWGFPRWASITTIFIGLIAIIAIVVSFIAPIIISNINNLIKQTPSLQKEAEQLINFSLRQMDKLPDDVTHRINKAVKSMGDGATSILSNSVSYITSFISTVFLLIMVPFFLIYMLKDHEKFIPAIGKFFKGERKVFVVDLLKDLNFTLKSYIQGQVTVSIILGIILYIGYTIIGLPYTPLLVLFAGVANLIPFLGPWLSFAPAAILGIIDGPSTFIWVCVVTLIAQQLEGNVITPNVMGKSLSIHPLTIIVVILAAGDLGGFTLILVAVPLYAVIKTLVSNIFKYRQRIVDKANSNVKD

SEQ ID NO: 3973 - protein, 463 aa, Staphylococcus epidermidis
NQIEINVEVKIMSVLSQLLKKSSPQQGIILYYLFAIVVAFLLLNLPYVHKQGVEVNPIDTLFVAVSGISVTGLSPITIVDTYSTFGQIIILIILNIGGIGVMAIGTMLWVVLGKHIGIRERQLIMLDNNRDTMSGTVKLILEIVRTIFIIEFIGALLLAFYFYRDNPDLKNALMQGIFVSVSATTNGGLDITGESLVPYAKDYFVQTIVMFLIVLGSIGFPVLLELKAYIKNRVTNFRFSLFTKITTTTYLFLFLFGVIVVLILEHSNAFKGLSWHQSLFYALFQSSTTRSAGLQTIDVSHFSDATNIVMGLLMFIGSSPSSVGGGIRTTTFAILILFVINFNNTGDKTGIKIFNREVHIMDVQRSFAVFTMASLITFISMIIISATEQGKLSFLQIFFEVMSAFGTCGLSLGVTSDVNDITKAVLMILMFIGRVGLISFIIMLAGRKEPEKYSYPKERIQIG

SEQ ID NO: 3974 - protein, 110 aa, Staphylococcus epidermidis
GGNEIMRGGGNMQQMMKQMQKMQKKMAQEQEKLKEERVAGTAGGGMVTVTVTGHKEVVDVEIKEEAVDPEDIEMLQDLVLAATNEAMNKADELTQQRLGKHTQGLNIPGM

SEQ ID NO: 3975 - protein, 109 aa, Staphylococcus epidermidis
GLRFKISYIPLAIVIETSITAPSVPISTEARKTSLGGRVRKVIVSYFIPFPPVNLMMTSVIPTHKNVPISVLTIVIKVRLCQPVTSSKVKEVEMIIAQVIKKNKLIAPY

SEQ ID NO: 3976 - protein, 203 aa, Staphylococcus epidermidis
NMIEVTFMSTNNEIEFKQILNQDTYSKIYELYFKNQSPFKQTNFYIDTENFKLKQHQAALRIRVKDYMYEMTLKVPAEVGLTEYNHSVNIEPKLDMSLQLSQLPNDIRNILEQDFNILENELKVLGNLTTYRLETEYQNELLVLDKSEYLGKTDYELEFEVHSYDEGYSKFKSLLQHFNLQHQKPLNKVQRFFQEKQNASDKD

SEQ ID NO: 3977 - protein, 332 aa, Staphylococcus epidermidis
WGEEMLMAINQQGQKILAQHANKFDKYQCPHCKSEVILKQGMTLIAHFAHKTRFNHRCSKSESVEHYEAKLYLARIYKALNFNVEIEPYYKEVLQYPDIVINQENAIEVQFSKISISKIIRRTTGLKRIGLNVIWIIKDVPLKYKYVKLSPFQSAFIHPINRTLVTWDSKKFVLILYSQLQHVGGKNFVAQRKVLKFEDIINMTFQSNNVPNFRLSASNIQRYINYCRKRHSVLEPTLSAMYQLNMYDSDVICKLGYVVPHQIYLITHPIEWQLKYLLLRRTLNDNELCKQLLSQVKFRVFATFQYDKRQILSTILREFDYLYEHESLNVQK

SEQ ID NO: 3978 - protein, 507 aa, Staphylococcus epidermidis
NKGELIMIYTVTTTLPLSHGGRTQALLRRIKLLDEEFKIPSKILTTNYHGNYPSIYKKYRQENKVTENIQFENMYEWLSNFKLFKVPKTLITRNPKYIKTPRKIKGLIDKQGKKSGLIHYYNNECHVRSRKYYGQSNVLEYEDFISPTSGLKYERHQYNLYGQLHRKEYYYDDSSLKHSDELFDTEGSMYCKRYFKTKPNSKINGVEIYRNKKLYKTFKNDKLLAQFYFQNRFKNQDIVFNDARFLDKPLLKQTHQTKNILVLHSSHLSGDQIKKSYRFALNQSKNVYKYIVLTHQQKHDIQQHFHISDDQFQLVPHFIELDTEVEQDSSNNQNRFIYIGRFSTEKQIDHIIRAYHKFLQSGYQTELHLFGRDEDNQIPLMNTLISELKLSDKVKIFKYTNQPLQKFKNSKASLLTSQYEGFGLTLMESIEMGCPVLSYNVRYGPSEIIQNGINGYLIEKNDIDSLSKHMINIIEHPLQKVKNKDTLKYNAAVNNYKQLMQSLDLLK

SEQ ID NO: 3979 - protein, 871 aa, Staphylococcus epidermidis
NNLDINQMTYAVQGALQKAVAYSKEYELQNIEVEALLKAAMNENDSLFKSILERANIDVDQLIKAYDNQLSHYPTVQGDNVQYGQYISAKTNELLDKAEKYMKSYEDEFISMEHILRAAIDTDETTQKWVGNKVEVIKEIITKVRGGNHVTSQNPEVNYEALEKYGRDLVEEVRQGKMDPVIGRDEEIRNTIRILSRKTKNNPVLIGEPGVGKTAIVEGLAQRIVRKDVPESLLDKTIFELDLSALVAGAKYRGEFEERLKAVLKEVKESEGRIILFIDEIHMLVGAGKTDGAMDAGNMLKPMLARGELHCIGATTLNEYREYIEKDSALERRFQKVGVSEPDVENTISILRGLKERYEVYHGVRIQDRALVAAAELSDRYITDRFLPDKAIDLVDQACATIRTEMGSNPTELDQVNRRVMQLEIEESALKNESDNASKHRLEELQEELSNEKEKQSSLKSRVEQEKEKIAKVQEKRAELDSSRQALEDAQTEGNLEKAAELQYGTIPQLEKELQEFEEAFQDETGEDSERMIREVVSDEEIGDIVSQWTGIPVSKLVETEREKLLSLSDILHKRVVGQDKAVDLVSDAVVRARAGIKDPNRPIGSFLFLGPTGVGKTELAKSLASSLFDSEKHMIRIDMSEYMEKHAVSRLIGAPPGYVGHDEGGQLTEAVRRNPYSVILLDEVEKAHSDVFNVLLQILDEGRLTDSKGRSVDFKNTIIIMTSNIGSQVLLENVKDAGEISDDTEKAVMDSLHAYFKPEILNRMDDIVLFKPLSVDDMSMIVDKILTQLNMRLLDQHISIEVTEEAKKWLGEEAYEPQFGARPLKRFVQRQIETPIARMMIKESLPEGTIIKVDLNDNKELDFKVVKPTS

SEQ ID NO: 3980 - protein, 209 aa, Staphylococcus epidermidis
NKMDYVYTIYKNPRYNIIQKDNRYLMVDLEQNWYSYLCPMLNWFIPIKFTELTYQEFNNINIFHNGGQKSHGMMAAGVGVTISVLLRSLVGYIDINISRIWIVFMFLIGFVAVITLRLSIRKKLNHPAFNKKSKQKVILIPSFKNMILVVFCYFMMLFFSIAPFQMIFEEKKNILGYILWVGVLFIFTTLNMASISDRKVHAKIKNIRR

SEQ ID NO: 3981 - protein, 132 aa, Staphylococcus epidermidis
KKEEIMKNVSPFIYVKDVDKSLCYYKDVFNAQTEILMGKDGRTYHAQLIIGDETFVHFSDTFHKHPVSKNPHLIIECDSLEELERVYKRLIDDGGHAKVKLNKTFFNAYHAEVKDRLNGIIWVFNYFLDEHI

SEQ ID NO: 3982 - protein, 62 aa, Staphylococcus epidermidis
IGGFINVHKFLFDFVIIYASFINNYMVILFKSLYKFNQYLILYIIHYFYSCFPYFTHSRRNI

SEQ ID NO: 3983 - protein, 127 aa, Staphylococcus epidermidis
YVKLVWNKEETSMRIYINEIKLKDDGVYCFSEESTEGLEEVGQMLVDSDNYGFAYLLDDGQSYSYLIFVQETWSMLHENRDKRIIINNHLELKHFQEELDYVLNNIEGNNNYGKEFVSAVEKTFELE

SEQ ID NO: 3984 - protein, 128 aa, Staphylococcus epidermidis
MIKCVCLVEEKNHQLLLVQVRHRDKYYFPGGKIDEGESLVEALQRELKEELRLELAKDELEFIGTIVGEAYPQPNMLTELNGFKVNRAIDWSKVETDHEITDMKWFDINDSENIAPAVNTWIKEFIND

SEQ ID NO: 3985 - protein, 85 aa, Staphylococcus epidermidis
SEKCLISKSISSFLANSLTFSQAFVSLDATPMVTFLPLLPPHADKTKIATIKKLKIFFINEFPLNIYKTLTSILISTDNPSDKVT

SEQ ID NO: 3986 - protein, 86 aa, Staphylococcus epidermidis
IKECRNMKRTFLLTYTTVSGKTYTEFKTFENGPDYDTCVSRIIDEFDELAYLYIKKDVVHYINVDHIESLDIEEVTEGQHITYDFE

SEQ ID NO: 3987 - protein, 96 aa, Staphylococcus epidermidis
FVIRKASYGQTPHVHFEIVPITEDGRLSAKDVVGNKKALASFQDKFNEYVNERGYELEQGTSRELTNRQHDQVNSYKQKTEYHKKEYERRYKIQPI

SEQ ID NO: 3988 - protein, 454 aa, Staphylococcus epidermidis
KGIRVSISYIYKGETAMNKIIIVGAVAGGATCASQIRRLDKESEIIVFEKDRDMSFANCALPYYIGNVIEDRRKVLAYTPNQFYDKKQITVKTYHEVIQINDERQKVTVLNHQTNQTFEESYDTLILSPGASANRLNTHSDISFTVRNLEDTETIDTFITNTKAQRALVVGAGYISLEVLENLHHRGLDVTWIHRSTNINKLMDQDMNQPIIDEIEKRNITYRFNEEISHVNGHEVTFTSGKVENFDLIIEGVGTHPNSQFIKSSNVILNDKGYIPVNHNFQTNIPNIYALGDVITSHYRHVNLPAQVPLAWGAHRGASIIAEQLSGNSSIHFKGYLGNNIVKFFDYTLASVGIKPNELKNFDYDMVEVKQGAHAGYYPGNSPLHLRVYFEKDSRKLIRAAAVGKQGADKRIDVLSMAMMNNATVDDLTEFEVAYAPPYSHPKDLINLIGYKAQ

SEQ ID NO: 3989 - protein, 164 aa, Staphylococcus epidermidis
KAMRYVYGSEKVLPLSKKTSHHARIYIGQPTKIFNTRRCFLMSSDTNGLAHTKWNCKYHIVFAPKYRRQVIYGKIKRDIGVILRQLCERKGVEIIEAEACKYPVGVVEDQIYYFNEDNIDNVIFEGYSDQDETRFQELFKEMMGNLDEDIKRGTVQQKDSYGLI

SEQ ID NO: 3990 - protein, 500 aa, Staphylococcus epidermidis
KKERYILNASALFKKIRVKNVIGTLDIQVDDITTDSRTAKEGSLFVASKGYTVDSHKFCQNVVDQGCGIVVVNRELELKGNVTQVVVPDTLRVASLLAHELYEFPSHQLTTYGVTGTNGKTSIATMIHLIYRKLNKNSAYLGTNGFQVNETKTKGANTTPETVALTKKIKEAVDANAEAMTMEVSSHGLALGRLRGVEFDVAIFSNLTQDHLDFHGTMEAYGHAKSLLFSQLGEDLSKEKYVVLNNDDDFSDYLASVTPYEVFTYGITHEAQFMAKNIKESLQGVEFEFCTPFGSFPVKSPYVGRFNISNIMAAMIAVWSKGTNLNEIINAVTELEPVEGRLEVLDPSLPIDLIIDYAHTADGMNKLIDAVQPFVKQKLIFLVGMAGERDLTKTPEMGRVACRADYVIFTPDNPANDDPKMLTAELAKGATHNNYIEFDDRAEGIRHAIDIAEPGDTVVLASKGREPYQIMPGHVKVPHRDDLIGLKAAYQKFGGGPLED

SEQ ID NO: 3991 - protein, 593 aa, Staphylococcus epidermidis
RNYRSGLLVDNNKKQVIPRSQYRRKRREYFHNVEREERIRREKIEKENQAKREQHQTKVNEERVKDNLRKARIEKLTQEEIHQQRDDKSYKQKTLNQNNQMNKSKDDDNKIGEESLHDVRVSSDTSTLPHQNKSIKDYDDSGNESKQHTKLTSKESMLGVNSNHTEQDSRSTQPYSSKHSYSQPKDKDNDNTQQAQFLKKEDKQRNRAENIKKVNEFKQLVVAFFKEHWPKMLIIIGIIVLLLILNAIFTTVNKNDHTNDSAFNGTAKDETTAMKIAENSVKSVVTVENDLSNDTTVSDNKNESDNEIGSGVVYKKVGDSIYIFTNAHVVGDQEKQKVTYGNDKSVTGKVIGKDKWSDLAVVKAKVADENIKPMTMGDSNNIKLAEPILVIGNPLGTDFKGSVSQGIVSGLNRHVPVDIDKNDNYDALMKAFQIDAPVNPGNSGGAVVDRDGRLIGIVSLKIDMHNVEGMAFAIPINDVRKIAKELEHKGKVNYPNTEIKIKNVGDLDDSERNAINLPAKVNHGVLIGEVKENGLGDKAGLKKGDVIVELDGKKIEDNLRYRQVIYSHYDDQKTITAKIYRNGAEKNIKIKLK

SEQ ID NO: 3992 - protein, 130 aa, Staphylococcus epidermidis
SRNRSRPVMKKTKGIYESEISKAITQWEKDFLGRGSLSVKTDILRDMVIVSLQGILTPAEYRVCKTNEGLLNIKRTRSELVESGEEDLSRIIKDLTGLNVKSFHSDLSTITGERVMIFKLEDRFDKALHE

SEQ ID NO: 3993 - protein, 317 aa, Staphylococcus epidermidis
RGWLLMSNENVLLQVKNLKQYFNQGKHNEVKAIDNISFDVYKGETLGLVGESGCGKSTTGKAIIKLNDITDGAIEYDGKDIHQIRKRKERLKFNKKIQMIFQDPYASLNPRLKVMDIVAEGIDIHKLASSQRDRKKRVYDLLETVGLGKEHANRYPHEFSGGQRQRIGIARALAVEPEFIIADEPISALDVSIQAQVVNLLLKLQRERDITLLFIAHDLSMVKYISDRIAVMHFGKIVEIGPADDIYNYPLHDYTKSLLSAIPQPDPDVERNRQRVLYHEDATLNEERQLNEIRPQHYVFSTQNEAVKLKQKYGLSV

SEQ ID NO: 3994 - protein, 90 aa, Staphylococcus epidermidis
SVSRVIKIAQRIMEDYECIKSVSALEDKEKEIREKDDLLNKAVGRIENTYDNFNRLYEMAKPFKENVEIALKLLKILLKELMKKHICGKS

SEQ ID NO: 3995 - protein, 514 aa, Staphylococcus epidermidis
IESRKTFAIISHPDAGKTTLTEKLLYFSGAIREAGTVKGKKTGKFATSDWMKVKQERGISVTSSVMQFDYDDYKINILDTPGHEDFSEDTYRTLMAVDSAVMVIDCAKGIEPQTLKLFKVCKMRGIPIFTFINKLDRVGKEPFELLDEIEETLNIDTYPMNWPVGMGQNFFGIIDRHSKTIEPFRDEENLLHLNEDYELKEEHAIKNDSAFEQAIEEMMLVDEAGEAFDNEALLNGELTPVFFGSALANFGVQNFLNAYVDHAPMPNARQTKEEVDVSPFDIDFSGFIFKIQANMDPKHRDRIAFMRVVSGAFERGMDVTLQRTNKKQKITRSTSFMADDKETVNHAVAGDIIGLYDTGNYQIGDTLVGGKQKYSFQELPQFTPEIFMKVSAKNVMKQKHFHKGIEQLVQEGAIQYYKTLHTNQIILGAVGQLQFEVFEHRMNNEYNVDVVMEPVGRKIARWIENEEDIKDNMNTSRSILVKDRYDNYVFLFENEFATRWFEEKFSDIKLYSLL

SEQ ID NO: 3996 - protein, 161 aa, Staphylococcus epidermidis
KAQRFAKLKSARRVIAIDHVEHRLAHTEKYNGAEVYNFLKEDDVGKLLHETTRGGADVVIDCVGIDEQVVQDDLEVSSNSIQRGNISPIVTATESVRKYGTIQLIGVYGTAADNSQLDLIFNRNVQVKSGQAPVIHMMPKLYDMIKIKSLIQQKLSLILCL

SEQ ID NO: 3997 - protein, 117 aa, Staphylococcus epidermidis
FHMSYENACDVICVHEDKVNNALSFLEDDKSKKLLNILEKICDEKKLKIILSLIKEDELCVCDISLILKMSVASTSHHLRLLYKNEVLDFYKEGKMAYYFIKDDEIREFFSKNQEGF

SEQ ID NO: 3998 - protein, 242 aa, Staphylococcus epidermidis
DDMRIERVDDTTVKLFITYSDIEARGFSREDLWSNRKRGEEFFWSMMDEINEEEDFVVEGPLWIQVHAFEKGVEVTISKSKNEDAMNMSDDDTNHQFDDQVNELLAQTLEGEESLEDLFEQRKQQKKNHQDKQQRRAHKPSNVRNIIVKFDDLEQVIDYAYHNNQNTDEFEDLLYMIDNKYYYSIHFDDSVSQEMINDSYSQLLEFAYPTDKTNIYLNDYAKIIMSHNVTSQVRKYFTDTNE

SEQ ID NO: 3999 - protein, 468 aa, Staphylococcus epidermidis
ICFGGVNMSNETEMKDNVREDVYDKELFDRLLDQNDIDEFRKEFLELHNYEQSEYFEDTDDENRQKIFEFLSPKEVANFFDQLDFDDDDYESLFDNMDATYASHVLEEMSYDNAVDILNELSKPKVASLLTLMNKDKANEIKALLHYEEDTAGGIMTTEFISLKSTTPVKEALIHVKEQAPDAETIYVIFAVNEDEQLVGVLSLRDLIVAENDAYIEDVMSERVISANVGDDQEDIAQLMRDYDFIAVPVVDYQNHLLGIITIDDILDVMDEEASEDYSRLAGVSDIDSTSDSVFKTASKRLPWLIVLTFLGMITATILGSFEDTLSQVALLAAFIPIISGMSGNSGTQSLAVSVRNISTGEINEQSKFKIALREAGSGLLSGIVCAVILFLIIVVIFRQPLLALIVGGSLTCAMTVGTLVGSMIPLVMNKCKIDPAVASGPFITTINDIVSMLIYFGLATSFMSYLT

SEQ ID NO: 4000 - protein, 169 aa, Staphylococcus epidermidis
MILGLALVPSKSFQDEVNAYRKRYDNHYAQIMPHITIKPQFEIDDHDFNLFKNEVKNRISSIKPVEVHATKASNFAPVSNVIYFKVAKTESLEQLFNQFNTEDFYGIAEHPFVPHFTIAQGLTSQEFEDIYGQVKLAGVDHREIIEELSLLQYSEEEDKWTIIETFTLG

SEQ ID NO: 4001 - protein, 548 aa, Staphylococcus epidermidis
RMKGFKVLIILLSVCIILSACSNKQSLYSDQGQVFRKVITQDMTTLDTALITDAVSGDIAAQAFEGLYTLNKEDKAEPAIAKSFPKKSNGGKTLTINLRKNAKWSNGDSVTAYDFVYAWRKVVNPKTASEFAYIMSDIKNADEVNAGKKSVKDLGITAIGKYKLQVDLERPVPYINELLALNTFNPQNEKVAKKFGEQYGTTAEKAVYNGPFEVTNWKVEDKIQLVKNEQYWDKKNVKLDKVNYKVLKDQQAGASLYDTGSVDDTIITSEQVDKYRGESALNYRLTAATFFIKMNQKTVPEFKNKHLRLAISQAINKKGYVNSVLNDGSLPSNNFTGVGTADTPDGKDFARTIKSPLKFNPDLAKKNWREAQKELGKNKFTFTMNTQDTPASKIAAEYIKSQIESHLPGVTLKIKQMPFKQKTTLELANNYEASYSGWSPDYPDPTAFLQTMTKNNAQNNTDWSNKEYDQLLKDANSKFLRKPGERNTSLQKAEYILLHEAPVAPVYQKGEAHLTNPQVKGLQYHKVGPETTLKHVYIDKSINRETGK

SEQ ID NO: 4002 - protein, 330 aa, Staphylococcus epidermidis
SRGGFQVQKKYITAIIGTTALSALASTHAQAATTHTVKSGESVWSISHKYGISIAKLKSLNGLTSNLIFPNQVLKVSGSSSRATSTNSGTVYTVKAGDSLSSIAAKYGTTYQKIMQLNGLNNYLIFPGQKLKVSGKATSSSRAKASGSSGRTAIYTVKYGDSLSAIASKYGTTYQKIMQLNGLTNFFIYPGQKLKVPGGSSSSSSSNNTRSNGGYYSPTFNHQNLYTWGQCTWHVFNRRAEIGKGISTYWWNANNWDNASAADGYTIDYRPTVGSIAQTDAGYYGHVAFVERVNSDGSILVSEMNWSAAPGNMTYRTIPAYQVRNYKFIH

SEQ ID NO: 4003 - protein, 67 aa, Staphylococcus epidermidis
FKGGLVMTVAEVGNIVEFYDGLRGRVEKINDNSVIVDLTIMDNFNELDLPEKTVINHKRYKIVDQEG

SEQ ID NO: 4004 - protein, 349 aa, Staphylococcus epidermidis
VLWGVFDMDLLIGTLFLILVLVIFTLFTYKAPSGMRAMGALANAAIASFLVEAFNKYVGGQVFGIKFLEELGDAAGGLGGVAAAGLTALAIGVSPVYALVIGAACGGMDLLPGFFAGYIVGYMMKYTEKYVPDGIDLIGSIILLAPIARLIATGLTPVVNNTLIKIGDIIQSSTDANPLIMGIVLGGIITVVGTAPLSSMALTALLGLTGAPMAIGAMAAFSSAFMNSALFHRLKLGDRKSTISVGIEPLSQADIVSANPIPIYVTNFFGGAIAGIIIAWSGMINNATGTATPIAGFLVMFGFNSLTKVIIYGVVMAIIGTIAGIVGSIVFKKYPIITKKQMLERDTTT

SEQ ID NO: 4005 - protein, 288 aa, Staphylococcus epidermidis
IFRGNSFMKKILSFLIVAILVLSACGGNNGKKVTIGVASNDTKAWEKVKELAKKDDIDLEIKHFSDYNVPNKALSDGDIDLNAFQHFAFLDQYKKAHKDTNIEALSTTVLAPLGIYSDKVKNIKDVKKGAQVAIPNDVSNQARALKLLESAGLIKLKKNFGLNGTTKDIESNPKDLKIKAVDAQQTARALSDVDISVINNGVATKAGKDAKKDPIYLEKASSDAVKPYINVVAVNSKDKDNKTYKKIIELYHSKEAQKALKEDTKDGEKPVDLSKKEIEEIENELAKK

SEQ ID NO: 4006 - protein, 139 aa, Staphylococcus epidermidis
KDGGTNMLHVHILSWVLAIILFIATYLNYSQTQGASPYYKPLHMALRLFMLLTLISGFWELIEEFMAASNGEGGNHMLLTLKMLCGLAVIAFMEISIAKRKKQQTSHKFFWITIILIIITMAIGVILPWGPISKIFGIS

SEQ ID NO: 4007 - protein, 208 aa, Staphylococcus epidermidis
GVIMIQTIVTAAILYIATAVDLLVILLIFFAKAKTKKEYRDIYIGQYVGSVTLIVVSLFFAFVLNYVPEKWILGLLGLIPIYLGIKVAIYDDCEGEKRAKKELNEKGLSKLVGTVAIVTIASCGADNIGLFVPYFVTLSVTNLFITLFVFLILIFFLVFTAQKLANIPGVGEIVEKFSRWIMAVIYIALGLFIIIENDTIQTILGFIF

SEQ ID NO: 4008 - protein, 1162 aa, Staphylococcus epidermidis
GNVMEFNTYIGRAGTGKSTAMLNQIKNKMKQDPLGDPIVLIAPTQSTFQLEQAFVNDSELHGSLRTEVLHFERLSHRVFQEVGGLTEQRLSKDALEMMIFHIVQQHESDLKLYGSQAQYYGLSEKLAEQIQDFKKYNVTPEHLNQLIENHSIQTRTKHKLEDISLIYKQLESRMNGEFITTEDSLQQFIEILSQSQWIKKAEVFIDGFHNFSTLEYRIIEALVQHAKQVTVLLTTDGSHHPFSLFRKPSEVLSHLEDIANRLNINLNKTYFNTFYRYNNDDLKNLENGFDALQFTPKHHQNHVKIFESSSMREEINEVARRILKDVREADYKFRDIAILYRDESYAYLFESILPSYDIPFNIDTKKSMTHHPIMEMLRSLLEVIRSNWHINAMLRLFKTNVLTSQFKRSSYLIDLLENFVLERGIYGKRWLDEDIFSIDQFSRMGRKSHQLTEGHQALYKEVIKLKKNVINKVLYFEQAMNEAHTVKDYATSFYESLEYFELPSQLMTQRDELELAGLTEKAEEIDQVWNGLIQILDDLVTVFDDQEMTLQQFLDVFDIGLEQLEFVMIPQTLDQVSIGTMDLAKVDNKKHIYMVGMNDGILPQTVSSSSLITDEEKKYVEDNAHVELSPTSDILQMDEAFVCYIAMTRSQQSVTFSYSLMGNSGDEKEISPFLTQIKELFYDLEIINLQDLHKAQPLLMMQHSHQTKIQLFEYLRGWLDHEDIDYRWLDAYLAIRDDDQLNQGLDYLTTSLTYDNETVQLNEILSQQLYGKTINASVSRFEGYQQCPFKHYASHGLRLNERTKYELQNFDLGDIFHSVLKYISDRIYGDFKNLDTKNIQSLTKEALELILPKVQFNLLNSSAYYKYLSKKIGSIVETTLKALKYQGEYSKFVPQRFETGFRKSPKNKGELVAQPLITNQGIPINIRGQIDRIDTYTKGDHSYVNIIDYKSSESSATLDLTKVYYGLQMQMMTYMDIVLQNKERLGLTDIVKPGGLLYFHVHEPRIKFKSWADIDEDQFQKDYIKNFKMSGLLNRDQEVLDALDIRLEPKYNSDIVPIALTAKGAINQRSSKVADENIIYQLIEHNKKNFIETASHIMDGHTEVAPLKYKQVLPCQFCNYKSVCHVDGLIDSKRYRTVDESIKPLDLIQQLRNEGGERHDSN

SEQ ID NO: 4009 - protein, 260 aa, Staphylococcus epidermidis
GVTIMLNLENKTYVIMGIANKRSIAFGVAKVLDRLGAKLVFTYRKERSRKELEKLLEQLNQSEHHLYEIDVQNDEDIINGFSQIGKDVGQIDGVYHSIAFANMEDLRGRFSETSREGFLLAQEISSYSLTLVAHEAKKLMPEGGSIVATTYIGGEAAVQNYNVMGVAKASLEANVKYLALDLGEDNIRVNAISAGPIRTLSAKGVGGFNTILKEIEARAPLKRNVDQEEVGKTAAYLLSDLSSGVTGENIHVDGGFHAIK

SEQ ID NO: 4010 - protein, 224 aa, Staphylococcus epidermidis
GGYINMFGSSLDSSQLLQALYETLYMVTVSLVIGALIGIPLGILLVVTRKNGIWSNTILHQVLNPIINILRSIPFIILLIAIVPFTKLLVGTSIGTTAAIVPLTVYVAPYIARLVENSLLEVDDGIIEAAKAMGASPLQIIRYFLLPEALGSLILAITTAIIGLIGSTAMAGAVGGGGIGDLALVYGYQRFDTIVIVITVIVLIIIVQIIQTLGNFIARVIRRN

SEQ ID NO: 4011 - protein, 148 aa, Staphylococcus epidermidis
LQYIDGLIDKQLIDEDAKEDVRRDEIMHFIDGPLYMEIAQADNVYTELPFVVNQIKVDGLTSEDEDVSIIQGMIDLIYESDGQFYFVDYKTDAFNRRKGMSDEEIGNQLKEKYQIQMTYYRNTLETILKRPVKGYLYFFKFGTLEIDD

SEQ ID NO: 4012 - protein, 617 aa, Staphylococcus epidermidis
GGHMEFLSLVIVVVAAFMTPIIVHRFNINFLPVVVAEILMGIVIGHSFLNLVERDAFLNILSTLGFIFLMFLSGLEIDFNAFKKDSRPRQGEDKHEKDVPGHLKLALTVFAFIMMISVVLAFAFKWLGLVNDVLLMVIIISTISLGVVVPTLKEMNIMRTTIGQFILLVAVLADLFTMILLTVYGAIYGEGGSTIWLTGILVVFTVVFYVIGVLFKRMSFLQKLMDGTTQIGIRAVFALIILLVALAEGVGAEYILGAFLAGVVVSLLKPNEEMVEKLDSFGYGFFIPIFFIMVGVDLDIPSLIKEPSLLLIIPVLIFSFIISKLIPVFYIRRWFDTKTTIASAFLLTSTLSLVIAAAKIAEKLKAISPETSGILILSAVITCVFVPVIFKKMFPIPNEVGRRIEVSMIGKNQLTIPIAQNLTSQLYDISLYYRKDLSDSRKLSDDITMIEIADYEEDLLERLGLFERDIVVCSTNDDHINKSVALMAKKHGVKRVICRLESTNEDPTLKHQGIEVFSNYLSNKILLKSLIETPNMLNLLSNVETSLYEIQMLNYQYENIQLRNFPFGGDIIFVRIIRDNDSIVPHGDTQLRYKDRLIVTGTKEYVDELKQELEFYY

SEQ ID NO: 4013 - protein, 233 aa, Staphylococcus epidermidis
VNHIKEIGVDMNFKYMNIAKGIIPILISMIILLSFISTHVLAQNQWLRMVDLSVQEWFSNQFGDPNRVFGHGFINNIMTFCATFGDVKTILIVATIIAVLLMFYKKVPQAIWLIITMTSGALINYLIKQTIERSRPENHLIVDTGWSFPSGHSNINTLFFLMIMIIIIPLIRQRAFKFIITILSIVFWISVLISRLYFHAHYFSDVVGGVSLAIIWVSLFILVSPLLNFWGEK

SEQ ID NO: 4014 - protein, 92 aa, Staphylococcus epidermidis
KQHIKNLVVDLLRIKSLQFHGMMINVYHYHSNDLIMLAIPELFWSIELSKELDANQLYEELVMQLFNLLTEVEADTLASNITDLIRNESKGE

SEQ ID NO: 4015 - protein, 332 aa, Staphylococcus epidermidis
ASNMETLFSGIQPSGIPTIGNYIGALKQFVDVQDDYECFFCIVDQHAITVPQDRLKLRKQIRQLAAIYLATGIDPDKSTLFIQSEVPAHVQAGWMLTTIASIGELERMTQFKDKAQKRADGVPAGLLTYPPLMAADIVIYNTNIVPVGDDQKQHMELTRNLVDRFNSRYNDVLVKPEVRMPKVGGRVMSLQDPTKKMSKSDDNQKNFISLLDEPHVAAKKIKSAVTDSDGIIKFDRENKPGISNLLSIYSGLTNESIKNIESKYEGEGYGKFKGDLSEIVKDFLINFQEKYASFYNSDDLDDILDKGKEKAQKASFKTLKKMEKAMGLGRKR

SEQ ID NO: 4016 - protein, 285 aa, Staphylococcus epidermidis
TMILTYQIVQSEPVKTFLKNQDYSKRTLSAIKLNGALLLNGSPVTVRHVMNKGDRLEVHFPCETPSENLIPYDKELEVIYEDAYLIIVNKPQMQNCAPSREHPHGSLVEQVLAYYTKKGEKINPHIVTRLDRNTSGLVVFAKFGHVHHLFSKVKFKKEYVALAYGHTQSSGVIEAPIARRSDSIIKREVNDKGKYAKTVYQRLMQNETASLCKVKLLTGRTHQIRVHFEYIGHPLIGDDLYGGNHPCVHGQALHCCSVEFIHPIYRSHYLINVDYKQLIKLFNMV

SEQ ID NO: 4017 - protein, 263 aa, Staphylococcus epidermidis
YNSINITREHRFMSEFKVGKINKKIIHSDILNRDVTLSVYLPEDYTNLFKYQLIFCFDGLDFFRFGRIQRIYEQLREEQSIQRAIIVGFHYEDVEKRREEFHPSGSRSNLTIKAMGKEILPYIDATFPTYKVGNTRLLIGDSLAGSIALMTAMTYPTIFSRVALLSPMYNENIKKKIDTCMNKGQLTIWHAIGLEEADFILPTNGKRANFLTPNRELNQLIKEDNIEYFYKEFNGGHHWKSWKPLLGDILLQFLGDPINGKYV

SEQ ID NO: 4018 - protein, 68 aa, Staphylococcus epidermidis
ITLISCVIIIIVTPNVRFTLLNKFKIELVVAGSRALVASSHNNILGCVTNALAMATRCFCPPDNSSGN

SEQ ID NO: 4019 - protein, 490 aa, Staphylococcus epidermidis
GIIMGEFKGFMKYDKQSLSELSLVDRLSNHEAFQQRFTKEDASIQGARCMDCGTPFCQTGQSYGRETIGCPIGNYIPEWNDLVYHQDFKAAYERLRETNNFPEFTGRVCPAPCEQSCVMKINRESVAIKGIERTIIDEAYENEWVHPAYPEDHKDQRVAIVGSGPAGLTAAEELNFKGYKVTVYEKAHEPGGLLMYGIPNMKLDKDVIRRRVSLMKDAGVLFKTGVEIGVDVSRETLEENYDAIILCTGAQNARDLPLEGRMGSGIHFAMDYLTEQTQYLNGEIESLSITAKDKNVIIIGAGDTGADCVATALRENCKSIVQFNKYTKQPEEITFESNTSWPLAMPVFKMDYAHKEYEAKFGQEPRAYGVQTMRYDVDELGNVKGLYTQILKETPDGMVMEDGPERFWPADLVLLSIGFVGTETTVPHAFDIHTERNKIVANDTNYQTNHAKIFAAGDARRGQSLVVWAIKEGREVAHSVDQYLSKEVLV

SEQ ID NO: 4020 - protein, 83 aa, Staphylococcus epidermidis
HIVIQFSMFIFLPTRINYTLHGCLSQQLFEINFSRLFNDSLSCFAQQINTIQTYSRFNNSKNYTIKNNSNYSGGKTELFLYEI

SEQ ID NO: 4021 - protein, 194 aa, Staphylococcus epidermidis
GFLMTHLPETIYVIRKGDMVIRPKYDEYQQTNGTEIIRFDQTRKESPFKVQRIIERSCKFYGNNYISKKAETNRITGISSKPPILLTPLFPTYFFPTHSDRQEENIWINMHYIENVKELKNRKSKIIFANGDSLTLNVSFHSLWHQYTNAIIYYYMVDKQSRMKSNNPEQPIDYNQSSLNIFEALSRYSLFEEN

SEQ ID NO: 4022 - protein, 161 aa, Staphylococcus epidermidis
NVLIDGKFINLYQSNIEKVNDNRHSNETSIHNDDYKKILNKVLKSDIIIFSTPLYWYSMSASLKLFIDRWTESLRDTQIDNFKEIMSQKKYLILIIGGDSPRIKAQPLVHQFKLIFEFMNITHFRFLIGEGNKPFDVLNDSQFMEELANTNLALKKGDIYD

SEQ ID NO: 4023 - protein, 767 aa, Staphylococcus epidermidis
YAIINVIKFIKGGQLMDFINITGASQNNLKNIDVNIPKHLVTVFTGRSGSGKSSLVFNTVAAESEQLLNESYSSYIQFHLNQQPRPKVKKIKNLPVAMTINQKRFNGNSRSTVGTVSDIYASVRLLWSRIGEPFVGYSDAYSFNSPKGMCKTCEGLGYIEDINLDELLDWDKSLNEGAIDFPSFGPDKERGKAYRDSGLFDNNKKLKDYTKDELELFLYQEPMTLKNPPKEWRKSAKYVGLIPRFSRIFLGDKEFNKKRYAKHLKNVVNNKICSTCKGQRLNSKILSSKIMSKNISDFTQMTIKENLEFLNKLEDPTAKYIIDPLKKQLEALEYIGLSYLTLNRVTTTLSGGEAQRLKLIRHLNSSLSDLVYIIDEPSVGLHPEDIAKINEILKSLKEKGNTVLIVEHDPDVIKEGDYIIDMGPGSGKNGGEITFEGTYNELLSSNTSTGNALRNKHNLKENIREANHFYNIGPVTQNNLNNVKTSIPKHVLTVLTGVAGSGKSTLVKAGFENNDHTIFIDQKAVQGSNRSNLLTYLGVFDSVRSYFSKETGLNKAMFSYNSKGACPNCGGKGYIKTELAFMGDFSQTCEVCHGKRYKQEVLDATIDGYSIADVLNLTVDEGIIFFDKKNDIKSKLQSVSKTGLNYMSLGQPLSTLSGGEIQRVKLGQHLDEEIKNSIFIFDEPTTGLHESDIPILMECFDDLIDQNNTVILIEHNLSIMCEADWIIDVGPGPGLDGGKVQFSGTPKNFIDSSETLTSKHLKRYIKQ

SEQ ID NO: 4024 - protein, 82 aa, Staphylococcus epidermidis
FFPIILTSMRRPTSLGIGNIFLNITGTKTHVITALRIKMPEVSGEIAFNFSAILAAAITSDKVDVSKKADAMVVLVSNQRLM

SEQ ID NO: 4025 - protein, 106 aa, Staphylococcus epidermidis
LLAIEPPISRKSSDIRKEKVQVLRSLKCFNPNEIKESFVRGQYDGGMMNNEFVPAYRNEPNVNSQSNTETFVAGKIEIENSKWASVTFYIRTEKRMKKIYPNRYRV

SEQ ID NO: 4026 - protein, 173 aa, Staphylococcus epidermidis
PKKISKALPVIITAGLCDTFLIVIAILGVSLILISMPTLQLFIYIIGFLFLMYMAWSLWTEKPSNIEEIEPMSAKKQILFALSVSLLNPHAIMDTVGVIGTSASVYDGYDKVVFSLATISVSWIWFVFLAILGRITGKIDKSGKYIVILNKVSSVIVIIVGLIILKNIVGILS

SEQ ID NO: 4027 - protein, 148 aa, Staphylococcus epidermidis
QLSIRQITFKCKNSCYIRYILMEHGDIMSKTPYELIGQKALYQMIDHFYQLVEKDSRINHLFPGDFKETSRKQKQFLTQFLGGPDLYTQEHGHPMLKRRHMEFTISEYERDAWLENMHTAIQHAQLPAGVGDYLFERLRLTANHMVNS

SEQ ID NO: 4028 - protein, 612 aa, Staphylococcus epidermidis
AIQIIKEVYIMSQQLTREEQERKYPEYTWDLTTIFKSDEAFEEAFKSIEAKIGEEEKFKGHLGESAETLYEALSLEDELGTKLEKVYVYAHLKQDQDTANDKYTGLEARAHQLVIKYSSAWSFLVPEILQLDEATIQSFIDSNNDLKRYEFDLKLINEKRPHILDANTEKLLTEAQDALSTPSNVYGMFSNADLEFEDAIDKDGQAYPLTQGTFIKYLESDDRELRASAFRNVYKAYGAHNNTLGATLAGEVKKNVFNARTHHYRSARERALSNNHIPEAVYDNLIKTVHKYLPLLHRYTKLRQELLGLDDLKMYDLYTPLVKDVKFEMPYEEAKSWMLKALEPMGEEYLNVVKKGLDNRWVDVYENKGKRSGGYSSGGHLTNPFILLNWSDTVSDLYTLVHEFGHSAHSYFSRQNQPSNLSDYTIFVAEVASTCNEALLSDYMDKHLDDERRLLLLNQELERFRATLFRQTMFAEFEHKIHQIEEAGEPLTPNRMNEEYAKLNKLYFGEAVETDDDISKEWSRIPHFYMNYYVYQYATGYSAAQSLSHQILTEGQPAVERYINEFLKKGSSNYPIEILKNAGVDMTTPQPIEEACEVFEQKLDAFEKLMKA

SEQ ID NO: 4029 - protein, 373 aa, Staphylococcus epidermidis
GFKMQSKNFFKTPFTWMMIIFSCLFLGTLIFTFFNDRFYNMPIGQITQITDIQSQKVTDEHKNKDIKYKEKITFKILNGEFKGQTTTIPHQYVKSQADSESFSKNDKVLLHISKNPKDATIIEKKRDTIVVIITGLFLLTVLVVGKKVGLQSILSLIVNTIAVMGAILIHDQYGAISLFFLMTCAIIISTSFTLLLVTGWHSRTLITIVSTLIGTFLCVGITEVIIKFTGGNGIKYETITFLTLPPKDVFLASVLIGTLGAVMDVSITIASGMYEILKRSPQISMKRWALAGRHIGQDIMGTMTNILLFSYLSGSLPMFLIYLKNANTITYTISMNWSLEVARALTGGIGIVLTIPITIALMELWFKLRGVNQ

SEQ ID NO: 4030 - protein, 88 aa, Staphylococcus epidermidis
YFRIQYLSGQASLNSEALAYFIFHVKQHSIFIHITFSFKVLNQTITFVDHKSIGTDYLVIANLHQSHYYELSMHLIPGKFFLDLNPYQ

SEQ ID NO: 4031 - protein, 62 aa, Staphylococcus epidermidis
INFVIYPLLCGLFCALLEVIDLWYAKKITKTHSKDWRFNPHLIWMMFIFSAVMGIIYVLLFK

SEQ ID NO: 4032 - protein, 332 aa, Staphylococcus epidermidis
GENVMKFISNNNINDPSLNLAMEEYVLKNLPSEESYFLFYINRPSIIVGKNQNTIEEVNQAYIDKHQIDVVRRISGGGAVYHDTGNLNFSFITDDDGHSFHNFKKFTMPIVQALQSMGVNAEMTGRNDIQVGQAKISGNAMVKVKNRMFSHGTLMLNCDLNEVQKALKVNPAKIKSKGVKSVRKRVANIEEFLEQPIDIEEFKKIILKTIFGENEVEEYILTEEDWKNIKQLSDEKYRTWEWNYGSNPKYNIEREEKFEKGFIQIKLDVKKGRIERAKLFGDFFGEGDVTELEHALVGCLHDFEHIEEALQNYDFYHYFGDIDKYEIIRLMS

SEQ ID NO: 4033 - protein, 307 aa, Staphylococcus epidermidis
NKTVFILLNGGKSTMDIKQLRYFVEVARREHISDAALELNIAQSAISRQITQLEKELGVTLFKRSGRNIILTVEGRQLLSQATQILELMDKTIHSFQQHVSHNQQTIYIGYEESDASQMILPLIQTFEQQSNSTMIPQLTKHDKLLDQILSNQLDLAITEFTPVLERETHLRVMPLFEENYYMYVPKSHPLAMTVHPPLSQFTNQSLYCLEPMTSSIKSKLIEKTKAQVRMISDMKLAQHILSHNKGFIISSQNSLLYDHVNWTKIPLNHTELKRMLCVVMRKDNKKNDINIAWNLICTLLNKSTIY

SEQ ID NO: 4034 - protein, 72 aa, Staphylococcus epidermidis
IFGVATNHLKESGLTNVKGLMRIIIEKPFGDDLKSAKKLNNQISKSFKEEEIFGIGHYLSKEMIQNIERLRF

SEQ ID NO: 4035 - protein, 77 aa, Staphylococcus epidermidis
KVVVFMNHNTEVKYTTLEDFVMTVNDLGVELVIEEALRNARKAKLKLLIDEALINKNENDFIQYTNEFKQLEAFLSE

SEQ ID NO: 4036 - protein, 80 aa, Staphylococcus epidermidis
YNTVKYPFQPLFIHKTKLSQSVHIVSEFNSTKLSLTFQKHLIFVRILHKLPLLVEVLSCQHLHFLIFQSDSLSYPFLRIH

SEQ ID NO: 4037 - protein, 1076 aa, Staphylococcus epidermidis
EMKVVKDMIPTKPHDVIWTDAQWQSIYAKGQDILVAAAAGSGKTAVLVERIIQRILRDEVDVDRLLVVTFTNLSAREMKHRVDKRIQEASFKDPNNEHLKNQRIKIHQAQISTLHSFCLKLIQQHYDVLDIDPHFRTSSEAENILLLEQTIDDVLEQHYDKLDPHFIELTEQLSSDRNDDQFRSIIKQLYFFSIANPQPFEWLNQLAQPYKEENKQRELMQLINDLAMIFMKAGYEELQKSYDLFSMMESVDKQLEVIETERMFITKAIEGKVLNTDVITQHEFMSRFPAINSKIKEANEGMEDALNEAKQHYDKYKSLVMKVKNDYFSRNAEDLQRDMQQLAHRVAYLAQIVQDVIQSFGVQKRSRNILDFSDYEHFALRILTNEDGSPSRIAETYREHFKEILVDEYQDTNRVQEKILSCIKTGEEHDGNLFMVGDVKQSIYKFRQADPSLFIEKYNRFSSSGTESGLRIDLSQNFRSRQEVLSTTNYLFKHMMDEQVGEISYDDAAQLYFGAPYDEVSHPVQLRALIEASSENSDLTGSEQEANYIVEQVKDIINHQNVYDMKTGQYRKATYKDIVILERSFGQARNLQQAFKNNDIPFHVNSKEGYFEQTEVRLVLSFLRTIDNPLQDIYLVGLMRSVIYQFTEEELAKIRVVSPHDDYFYQSIKNYMIDEKADSRLVDKLNRFIQDIQKYQNYSQSQPVYQLIDKFYNDHFVIQYFSGLIGGKGRRANLYGLFNKAVEFENSSFRGLFQFIRFIDELIDRKKDFGEENVVGPNDNVVRMMTIHSSKGLEFPFVIYSGLSKKFNKGDLNAPVILNQQYGLGMDYFDVNKDMAFPSLASVAYRAINEKELISEEMRLIYVALTRAKEQLILVGRVKDEKSLIKYEKLAVSDTHIAVNERLTATNPFVLIYGILAKHQSPSLPNDQRFERDIDQLNSEVKPRVSIVIDHYEDVSTEEVVNDNEIRTIEELKAINTGNEDVKIKIHQQLSYDYPFKVNTMKPSKQSVSELKRQLETEESNTNYDRVRQYRIGVASYERPKFLTQTKKRKANEIGTLMHTVMQHLPFREQRLTKDE

SEQ ID NO: 4038 - protein, 313 aa, Staphylococcus epidermidis
FRRVYMTKYVLKRLCYMFVSLFIVITITFFLMKLMPGSPFNDTKLNAQQKEILNEKYGLNDPVALQYVNYLKNVVTGDFGNSFQYHNMPVWDLVKPRLIPSMEMGITAMVIGVVLGLVLGVAAATKQNTWVDYTTTIISVIAVSVPSFVLAVLLQYVFAVKLEWFPVAGWEGFSTAILPSLALSATVLATVARYIRAEMIEVLSSDYILLARAKGNSTLKVLFGHALRNALIPIITIIVPMLAGILTGTLTIENIFGVPGLGDQFVRSITTNDFSVIMATTILFSTLFIVSIFIVDILYGVIDPRIRVQGGKK

SEQ ID NO: 4039 - protein, 618 aa, Staphylococcus epidermidis
RNLLLIGKNVTMRKKLNNEYRSAKKIRYMPGLDGLRAIAVIGIIIYHLNKQWLTGGFLGVDTFFVISGYLITSLLLKEYEDTGTINLKNFWIRRIKRLLPAVFALIVVVGIATLLLHPEHIVRVKHDMIAAIFYVSNWWYIAKDVNYFEQFSFMPLKHLWSLAIEEQFYLFFPAVLLLFMAIVKKKKNVILMFWIISLVSLLMMVVISQPHLNHSRVYFGTDTRLQTLLLGVLLAFIWPPFKLNPNPPKGLKTVINSAGIIGLTFVILLFFNVSDESDWIYNGGFYLISTMTLLIIASVVHPTTILAKLLGNPLFVYIGKRSYSLYLWHFPVISFIHSYFIDGQLPTYVYIMDIVITVLLAELSFRYVETPLRKEGLKAFTFKKTYKPQFIRTIVTLIMLLPFIFILVGAFDKFGKDTISNKAQTFNTNEADQYLIHMIPIDNISLTSDGKTKENKKDNDVYTQIKPLLIGDSVMVDIGEQFKTKVPKAKIDGKVGRQLYQAESLVKNQYRHYNKPSDQIILELGTNGDFTKEQLDNLIDKFGKAQVYLVNTRVPRSYESHVNELMAKAAKNKKNVTLIDWYSRSKGHTEYFAPDGIHLENDGVEALTDEILKNIKKK

SEQ ID NO: 4040 - protein, 62 aa, Staphylococcus epidermidis
PIIFTTTRSPSFNVGSIESPLIEYDFPTNLVIMAISAMATAMATIHSKISFFKVYTSSGYLN

SEQ ID NO: 4041 - protein, 127 aa, Staphylococcus epidermidis
EVSLMSINSYLISSLFTPVLSIIIWLFYSNHFINLINILFYTSFIIFIVAFLILLIQEGIFDATSFGFRRLKYQLSSTKRKRMMKNDHFFNPQKVKKESYIISPWVVPTLIINLTYIIVSIGVSLLI

SEQ ID NO: 4042 - protein, 341 aa, Staphylococcus epidermidis
VIEFKNVNKVFRKKRETIQALKNVSFKIDQHDIFGVIGYSGAGKSTLVRLVNQLETVSDGQVIVDGHEIDTYKEKDLRDIKKDIGMIFQHFNLLNSKSVYKNVAMPLILSKTNKKEIKEKVDEMLEFVGLADKKDQFPDELSGGQKQRVAIARALVTHPKILLCDEATSALDPATTSSILNLLSNVNRTFGVTIMMITHEMSVIQKICHRVAVMENGEVIEMGTVKDVFSHPQTNTAKNFVSTVINTEPSKELRASFNSRKDSNFTDYKLFLDSEQIQLPILNELINEHHLNVNVLFSSMSEIQDETVCYLWLRFEHDESFNDFKLTDYLSKRHIRYEEVI

SEQ ID NO: 4043 - protein, 144 aa, Staphylococcus epidermidis
NNELNSFYRRVRCMVTLFTSPSCTSCRKAKAWLQEHDIPYTERNIFSEHLTIDEIKQILKMTEDGTDEIISTRSKTYQKLNVDIDSLPLQDLYSIIQDNPGLLRRPIILDDKRLQVGYNEDEIRRFLPRKVRTFQLQEAQRLVD

SEQ ID NO: 4044 - protein, 290 aa, Staphylococcus epidermidis
HMKPFKLIFISALMILIMTNATPISHLNAQANEENKKLKYEKNSALALNYHRVRKKDPLNDFISLLSGSKEIKNYSVTDQEFKSQIQWLKAHDAKFLTLKEFIKYKEKGKFPKRSVWINFDDMDQTIYDNAFPVLKKYHIPATGFLITNHIGSTNFHNLNLLSKKQLDEMYETGLWDFESHTHDLHALKKGNKSKFLDSSQSVASKDIKKSEHYLNKNYPKNERALAYPYGLINDDKIKAMKKNGIQYGFTLQEKAVTPDADNYRIPRILVSNDAFETLIKEWDGFDEEK

SEQ ID NO: 4045 - protein, 361 aa, Staphylococcus epidermidis
RNGTDSMKKNKLELVYLRAFICVIIIVTHLLTQITLENEQMSDSSLILQYYIRNIFIFGTPSFIILSQLLTTLNYESVTINYLFSRFKYIFIPYLLIGLFYSYSESLITASSFKKQFIENVVLGQWYGYFIIIIMQFFVLSYIIYKINFRLFNSKILLLLAFIVQQSYLHYFLNNDTFHQFMTHYYPLSENTMILGWIFYFFLGGYIGYNYEKILSFLEKYLIIVIMLTLGAYVLFIAVSGSDYWNVTSFTYTLTLYNSVMFFLLLGVCMHFKTMLLNTIKAISAFSFFIYLLHPIILDSLFAYTNIFEDNTIVFLAISLLMILGICIGVGMMLREFYIFRFVIGKQPYKLQFDQYQPNWN

SEQ ID NO: 4046 - protein, 64 aa, Staphylococcus epidermidis
NEFKDNYCRVIKKSFNYDQTGKRRRIIREFVKKLTLFHEYSILFIKIKSIQSDIFKHMLYIKSS

SEQ ID NO: 4047 - protein, 112 aa, Staphylococcus epidermidis
SIKKKERWLCYMVKPRQRQYPTVTSYLNIVRESLFITISGVFWMYCIVVMIVYIGTLINSQMESVITIRIALNVENTEIYKLFGWMSLFVLIIFIFFTFSLAFQKYKKGRDI

SEQ ID NO: 4048 - protein, 422 aa, Staphylococcus epidermidis
KFENLLFTLRRFFYNISLILIFDIKKREETLMKDNKMLFIIFMIGTFTVGMAEYVVTGLLTQIADDMKVSISSAGLLISVYAISVALIGPLMRIITLKVHAHRLLPILVAIFIISNLVGMLAPNFNVLLLSRLMSAAMHAPFFGVCMSVAATVAPPAKKTQAIALVQAGLTIAVMLGVPFGSFLGGFANWRVVFGFMIVLAIITMLGMIKFVPNVSLSAEANISKELTVFKNPHILIVIAIIVFGYSGVFTTYTFMEPMIRDFSPFKIVGLTVCLFMFGLGGVIGNLITGNVPEDKLTKNLYLTFLLLFVTIILFVTVIQNSILALIICFLFGFGTFGTTPLLNSKIILSAKEAPLLASTLAASIFNVANFLGAIIGSILLSIGLPYIQITLISGGIIVLGMLLNLVNQLYEKKHITFNEYS

SEQ ID NO: 4049 - protein, 506 aa, Staphylococcus epidermidis
SLGEAPSVTVIPATFASTESTATNQTQQTVLFDNSHAQTAGAADWVIDGAFSDYADSMRKQGYQVKELQGESNISDQSLQQAHVLVIPETNNPFKENEQKAIINFVKNGGSVIFISDHYNADRNLNRIDSSESMNGYRRGAYENITKDMNNEEKNSNVMHNVKSSDWLSQNFGVRFRYNALGDINTQNIVSSKDSFGITKGVQSVSMHAGSTLAITDPNKAKGIIYMPEHLTHSQKWSHAVDQGIYNGGGINEGPYVAISKIGKGKAAFIGDSSLVEDRSPKYLREDNGKPKKTYDGFKEQDNGKLLNNLTTWLGKKESQPSMKDMGIKLDNKTPLLNFEQPENSIEPQKEPWTTPIEGYKWYDRSTFKKGSYGSNQRGADDGVDDKSSSHQNQNAKVELTLPQNIQPHHPFQFTIKLTGYEPNSTINDVRVGLYKDGGKQIGSFSSNRNQFNTPGYSPSQSIKTNGAGEASFTLTAKVTDEIKDANIRVKQGKKILLTQKMNENF

SEQ ID NO: 4050 - protein, 198 aa, Staphylococcus epidermidis
YIFRKLNKGEILELKDKIIDNAITLFSEKGYDGTTLDDISKSVNIKKASLYYHYDNKEEIYRKSVENCFNYFIDFLLRNHDDNYSIDGLYQFLFKFIFDVDERYIKLYVQLSSAPEALNSEIKHHLQEINTTLHDELIKYYDPTHIALDKEDFINLILLFLETWYFRASFSQKFGIIEDSKNRFKDQVYSLLNVFLKK

SEQ ID NO: 4051 - protein, 418 aa, Staphylococcus epidermidis
RKVGEKMHVFNFLLFYPIFMSIYWIVGSIYYFFIKEKPFNRSLLVKSEHQQVEGISFLLACYNESETVQDTLSSVLSLEYPEKEIIIINDGSSDNTAEIIYDFKKNHDFKFVDLEVNRGKANALNEGIKQASYEYVMCLDADTVIDDDAPFYMIEDFKKNPKLGAVTGNPRIRNKSSILGKIQTIEYASIIGCIKRSQSLAGAINTISGVFTLFKKSALKDVGYWDTDMITEDIAVSWKLHLFDYEIKYEPRALCWMLVPETIGGLWKQRVRWAQGGHEVLLRDFWPTIKTKKLSLYILMFEQIASITWVYIVLCYLSFLVITANILDYTYLKYSFSIFFFSSFTMTFINIIQFTVALFIDSRYEKKNIVGLIFLSWYPTLYWVINAAVVIMAFPKALKRKKGGYATWSSPDRGNIQR

SEQ ID NO: 4052 - protein, 66 aa, Staphylococcus epidermidis
GNPIDNNIDPMIAPRKLATLKIEAANVLARSGASFALKIILLLSNGVVPNVPKPNKKQMINANIEF

SEQ ID NO: 4053 - protein, 533 aa, Staphylococcus epidermidis
DIVFNLYIIKLCLFPVLEEVNSMSQIAFYILSDVHGFIFPTDFSSREKDLPMGLLKANHLIEQDCVHYDGSVKIDNGDFLQGSPLCNYLVSKLKSSLPLTSIYNRLGFDFGTVGNHEFNYDLPYLKQAINQLHYPVLCANIIENTQPFTGQGIHYFKVNGLTIGTIGLTTQYIPHWEQPDYIKTLNFNSAIHTLKSELPTLREKSDIVVVSYHGGFERDLDSGLPTEALTGENEGYDILRQFSDSIDVLITGHQHRDIATIKNQTAIIQPGSKGTKVGKIVIEYTHDKKVLIKECNLMNVHNSTSFKPNDEDIALRNQLEDWLDTQIAELPYAMRINNSFEARKSPHAFVNLLNYILLEKSGADIACTALFDSANGFDEKVTMRDIINNYPFPNTFKVIELSGKDIKLAIERSASYFDIVNHKITVNKEFLEPKPQHFNYDIFAGIQYTIHVSHPYGERVSDLLINDAPLQSDQIYTICVNNYRAVGGGNYDMYVNKPVIKDIQIEGAQLLIDYLSHNDLSQIPQVIDFNVVK

SEQ ID NO: 4054 - protein, 699 aa, Staphylococcus epidermidis
PLPVVCTDVLTVKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 4055 - protein, 88 aa, Staphylococcus epidermidis
TDYSSIIFDALTVDKKGCLYTPNHSQYVEERGVYQDVMDTLKPIWYTDAELLINDLITDSIPQLNNKYTNKNNQSFEYISKLISNQLK

SEQ ID NO: 4056 - protein, 340 aa, Staphylococcus epidermidis
FNSSLEECRNMVEKFKAFVVDQDDNGIVSNSYKELTKDDLPEGDVLIKVHYSGINYKDALATQDHNKIVKQYPMVPGIDLAGTIEETNAPGFEVGDKVIVTSYDLGVSHYGGFSEYARVKSEWVIELPEDLTLEEAMIYGTAGYTAGLAIEQLEKSGMSIEGKEVLVRGATGGVGTISLLMLNNLGYDVIASTGRDDAEEKLKKLGAKEVIGRLPEDNSKPLEKRTWQAAIDPVGGENLPYIVKRLDNNGSVALIGMTGGNNFETTVFPFILRGASIIGIDSVFTPIKLRKRVWRRLAKDLKPQQLHDIKHVISFDEIPKAIDQVINHNNTGRIVIDFNV

SEQ ID NO: 4057 - protein, 362 aa, Staphylococcus epidermidis
DITSMEGGYKLNITKAIVVAIYIIVGAALGVIIIPEVVTDLGIHHHAVITNYYVDGFIGIIIFFIIFGLFINKVTYTFKQFEQLIMRRSAVEILFATIGLIIGLFISVMVSFILEMIGNSILNHFVPMIITIILCYLGFQFGLKKRDEMLMFLPENMARSMSNNIRRATPKIVDTSAIIDGRILDIIRCGFIDGDILIPQGVINELQVIADAKDSVKREKGQRGLDILNQLYDLDYPTRVIHPTQSHSDIDTLLIKLAQQYHAHVITTDFNLNKVCHVQGITALNVNDLSEAIKPNVHQGDQLSILLTKIGKEPGQGVGYLDDGTMVVVDNAKSYIGQQVNLEVVSLLQTSSGRIVFAKFVD

SEQ ID NO: 4058 - protein, 413 aa, Staphylococcus epidermidis
VKFLASQLFKGGFFIDYLGVDISKRSSVVAHYKNEKFQKEFFIQNNKNGYNYLLKYLNDLDHPQLIFESTGIYSRSMERFCCVNQINYIQMNPLEAKFKTSALRSWKTDQADAHKLACLGPTLKQTDNLPIHELIFFELRERVRFHLEIENEQNRLKFQILELLHQTFPGLERLFSSRYSIIALNIAEIFTHPDMVLDIDKEVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGGIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 4059 - protein, 295 aa, Staphylococcus epidermidis
FEMSAQDPRNKFKTDNYEKQEQEVPGIQAKMSPQPDCGEDSYHGHHRLDGFKILVTGGDSAIGRAAAIAYAKEGADVAINYLPSEQQDADDVKQIIENVGQKAILIPGDIRDEQFNYDMVEKAYQQLGGLDNVTLVAGHQLYQDELSEFKTQDFTETFETNVYPVFWTVQKALEYLQPGGSITTTSSVQGYNPSPILHDYAATKAAIISLTKSFSAELGPKGIRVNCVAPGPFWSPLQIVGGQPQSAIPTFGQNTPLGRAGQPVECAGTYVLLASDDASYITGQVYGVTGGTQID

SEQ ID NO: 4060 - protein, 67 aa, Staphylococcus epidermidis
ISQSSDYVRHLNHWTGFFISINLNNNQYKFAILIKNNLLRFIRTIEMITAFAFKILIYLLGFALTGY

SEQ ID NO: 4061 - protein, 71 aa, Staphylococcus epidermidis
VLLPFSKFIQIKICKKVHIKIHHSLFIENTSFLNFKLMLEKYLYFTLISPFSLINFTLLFPFSTLLLYNTR

SEQ ID NO: 4062 - protein, 159 aa, Staphylococcus epidermidis
FAMLWHLIFMIPTIIGYSFGMFCLISSETFKSKGFLLLGVGIFIFSLIYILIYSLVTLIPNVAILSRRFHDRSMTMTLPIIFYVFTVIVSGFNYLPNIDNSAVLIFMGIICLIYWIGSILILVLTCLDSKTESNKYGPSPKYNRNETNFHGDNANPVDK

SEQ ID NO: 4063 - protein, 200 aa, Staphylococcus epidermidis
FQLTRKVRYMNLNKQQHEYTALCLSQTENKSSEELFESLIEELKPLIYNKIRYISHNKYDIEDMYQEIVIKFYRALQKFDYQQGVPIEHYIYFLIRSVKYDYLRKVKANYKRQPLLVNEYIVEYNATLALNDIERSIIRKELTLAFKRSEVKLSRMERRIIRLLLNDYKPKEIAMVLNLESKVVYNAIQRSKCKLKRSFE

SEQ ID NO: 4064 - protein, 322 aa, Staphylococcus epidermidis
GIKTMLLFLCFLIELLLIVLLYTKQSFTLNLFSFILYNIIGFVMMTYHMVTVSIPYDMFIIVIVAMILLLIKHRYIFKLQTGRFFILQLSHHFYTVGLFAVSCLYISTIPLIIINSLALWAATIAFSTIYSFIGYLSWSTAFENHQYYKHVKLIMVLGAGIFSEEVTTLLAARLDKALSVYHSQRTKPIIIVSGGQGPDEPISEALAMKRYLIAHNVPENHIFMENQSTNTRTNFLYSKSIIHSMMPTSSQMLCVTSQFHVLRALKFAKKAHLSFDGIGSRTPYHFLAQSMIIDFLGLMYQYKTILTIYFAMLFWLAILQTI

SEQ ID NO: 4065 - protein, 210 aa, Staphylococcus epidermidis
MSETLQNQRQFNSQFEHQEIHRGKRYGKKKRSWVSLIIQVFVLVLTAITGYSMLKQPIFKISFVNETINFHQLRNFQDTVTQIGNLNLGNIDQLQQSVDNLIIIFNIFFVLCLISLFITVITIIFNRTALKVVNILLLAIMLVITLYFSYIIHTIAQKISESLKQYYLTVSPEQVLTEADAIHNALILIGCSIALLIVSLFFRNRLPRIK

SEQ ID NO: 4066 - protein, 158 aa, Staphylococcus epidermidis
MNKTFTVTRTVTEDAIDNNNHMHDAYYNIIFSEVINKFNEVHGLSWSERDRLQYTVFTVETHTTFLHELTLGQEFNIELFLYNYDDKRTHFFLRMLIDNQEVVATNEVMMLGIDRTQRRAAPFPKHYLNAIQDYAHKQEKIEWPPQLGHSIGIPYKGE

SEQ ID NO: 4067 - protein, 727 aa, Staphylococcus epidermidis
RERTYSMNKLTIIVTYYNAEEYITGCLESIKQQRTQDFNLIIVNDGSTDQSKKLMDEAIKDYDKNIRFIDLDENSGHAHARNIALEEVETPYFMFLDADDELASYAITFYLEKFNNTDGLIAPIHSFTTQRPQFVDLDRVRVEYFNAKENINSFLRKQSACNIIFRTAIVRAHHIRFNENLNTYVDWSFVLEYMKYVNKFVRIFNFPFYFRGEVYDPFETLTLSEQNFDILFKDYVNSFYDAIKRATNPKVREFIVTKMGNKIANEFEPTRYDINERYQTHKDTLVELSKFLHVHLVKNQKLINKIETILLMNNETDKAFKVNQFRKTLRHVKNIVLRRKNKERSLYDLTDKEDNVKPKTIVFESFGGKNYSDSPKYIYEYMQKYYPNYRYIWSFKNPDKNVVPGSAEKVKRNSAEYYQAYSEASHWVSNARTPLYLNKKENQTYIQTWHGTPLKRLANDMKVVRMPGTTTPKYKRNFNRETSRWDYLISPNRYSTEIFRSAFWMDEERILEIGYPRNDVLVNRANDQEYLDEIRTHLNLPSDKKVIMYAPTWRDDEFVSKGKYLFELKIDLDNLYKELGDDYVILLRMHYLISNALDLSGYENFAIDVSNYNDVSELFLISDCLITDYSSVMFDYGILKRPQFFFAYDIDKYDKGLRGFYMNYMEDLPGPIYTEPYGLAKELKNLDKVQQQYQEKIDAFYDRFCSVDNGKASQYIGDLIHKDIKEQ

SEQ ID NO: 4068 - protein, 499 aa, Staphylococcus epidermidis
KRGTVFVMNTQHSKTDVILIGGGIMSATLGTLLKELTPEKDIQLFERLSQPGEESSNVWNNAGTGHSALCELNYTKEGKDGSVDITKAIHINEQFQISKQFWAYLIREGHIESPDKFIQSVPHMSFVKGEENVKFLKSRVASLQKNVLFEKMKISQDPEKINSWVPLMMEGRQSDEAIAITYDETGTDVNFGALTKKLIANLQQKNVGINYKHEVLDIKKLNNGNWQVVVKDLNTSNVMNYESKFVFIGAGGASLPLLQKTKIKESKHIGGFPVSGLFLRCKNPDVIHRHHAKVYGKAEVGAPPMSVPHLDTRFVNGEKSLLFGPFAGFSPKFLKNGSYLDLVKSVKPNNMITMLSAGVKEFNLTKYLVSQLMLSNEERINDLRVFLPEAKDEDWEVITAGQRVQVIKDTDKSKGQLQFGTEVITSEDGSLAALLGASPGASTAVDIMFDVLQRCYKSEFKSWEPKIKEMVPSFGLKLSEHEDMYHSINEEVKKYLNVK

SEQ ID NO: 4069 - protein, 518 aa, Staphylococcus epidermidis
  UNSURE (6): Identity of amino acid at the above locations are unknown.
LTHAGXHIISRYEEDYANGTYMNSLYDKPLPGNYFLQNADDYLQILEQGVQFVLEDSKVNKNDVVGIGVDFTSSTIIFLDEQFEPLHRHEDLKTNPHAYVKLWKHHGAQDEANYMIQMSKNKNWLDYYGSSVNSEWMIPKILEVKHEAPEILRRARYIMEAGDYITSILTNSNIRSNCGIGFKGFWDNEAGFNYDFFHSVDPDLPKIVKEKCEAPIISIGESAGRLCKDYQQIWGLSQDVQVSPFIIDAHSGVLGVGAIEAGEFTAVIGTSTCHLMLDSRQVPISSITGSVKNAIIPGLYAYEAGQPAVGDLFEYSKNQAPKHIVDQANEHHMPVLNYLEELASHIRIEEQHVVVLDWLNGNRSILSNSHLTGSIFGLTLQTPYEMIHRAYIEATAFGTKLIMKQFEDNHIPVHTVYASGGIPQKSKLLVEIYANVLNKRVVVIDSSNASALGAAMLGANVGNAYSTLKEAALSMKQPIAYIQEPEIQKVQAYKPLYHKYCELHDLLGRQYPELSYLI

SEQ ID NO: 4070 - protein, 67 aa, Staphylococcus epidermidis
YADAHVTLNPNESEPESYDKYDVRVPVEQNDHTMKVELDVPKGLNVESVKTIEGFKHHFLKIKREHY

SEQ ID NO: 4071 - protein, 342 aa, Staphylococcus epidermidis
KVRARCLMMSNIHTNISEWMKMSEETPVIISSRIRLARNLENHVHPLMFPSEQEGYRVINEVQDALSNLTLNRLDTMDQQSKMKLVAKHLVSPELVKQPASAVMLNDDESVSVMINEEDHIRIQALGTDLSLKDLYQRASKIDDELDKALDISYDEHLGYLTTCPTNIGTGMRASVMLHLPGLSIMKRMNRIAQTINRFGFTIRGIYGEGSQVYGHIYQVSNQLTLGKTEEDIIDNLTEVVNQIINEEKQIRERLDKHNSVETLDRVYRSLGVLQNSRIISMEEASYRLSEVKLGIDLNYILLENFKFNELMVAIQSPFLIDDDDNRTVNEKRADLLREHIK

SEQ ID NO: 4072 - protein, 172 aa, Staphylococcus epidermidis
NEMAKYNVENEYVEIDIERLLKYTPEVVYEAWTKTDILKKWFMTTQRTNKSFDADIQEGGKYRIIDSRNGKQNIIEGTYEELVLDEYIKMTIGMPGLSEEEDVIEVEFFERENGGTQMFFYYRSFVEKERRLTTLEYKQKKKEYHDSTAHGFELMIDQMQNVIDEIEEQRHN

SEQ ID NO: 4073 - protein, 61 aa, Staphylococcus epidermidis
LSQAFYLLAIDNRVELGLISIFNSSPHYQVRQRITYAFYLTLLNLIFNVIIVVTQYAKLKL

SEQ ID NO: 4074 - protein, 662 aa, Staphylococcus epidermidis
GGHFMTATFIIIYIVVALILIGFINFFLIKRKRKNKDKRVEQRSTIDSKRESNQSKFKASDLEQTTKSNTDPTQSNDIEDEKRKNHFDSEIDNASQFINTDSKEDRNALSHKNQEEDDASNDVLNPIDPNSTEGRVNERIKNQESNFIFGKGITRGKILAAMLFGMFIAILNQTLLNVALPKINTEFNISASTGQWLMTGFMLVNGILIPISAFLFNKYSYRKLFIIGLALFTLGSLVCAISFNFPIMMSGRVLQAIGAGILMPLGSNVIVTIFPPEKRGVAMGTMGIAMILAPAIGPTLSGYIVQNYDWNVMFYGMFFIGIIAIVIGLFWFKLYQSTTNPKADIPGIIYSTIGFGSLLYGFSEAGNKGWGSTEIVTMFIVGTVFIIFFILRELRMKAPMLSLEVLKYPTYTLTTIINMIVMMSLYGGMILLPLYLQNLRGFSALDSGLLLLPGALVMGALGPVAGKLLDTIGIKPLAIFGIGIMTYATWELSKLNMDTTYLHIMWIYIVRSFGMAFVMMPIITAGMNALPPRLISHGNAFVNTMRQLAGSIGTAILVTVMTTQQTNHLSAFGEELDKTNPVIQDHMRELAQQYGGESAAMKLLLEHVNKLASVEGVNDAFIVATIISAIALILSLFLQGKKKAQLSAEKANAEDYPSQQDK

SEQ ID NO: 4075 - protein, 221 aa, Staphylococcus epidermidis
VKHLRLIGLPHKNKNTYVNLILRVSLMKAYLYKFMPLLIFVIGLIIFYVFNDYPTLIHVIVIIAFITNGLKNVYFVNNNIRNHMIWVSPKLDRILGMISGILYFGIYVVGFIKQQPLWIVMLILVSTVGTAVLLETKLHITSLQLEETLSSERIKRKVISRHKAQRLKCIFFTVIVVVIISMLISLYLKLMVIFGLAVTIFILASISVAIFEKYFTIIENM

SEQ ID NO: 4076 - protein, 72 aa, Staphylococcus epidermidis
VHLLRSSILALLHLSCVVALLFIKVSNYILHEIQIFNIPHFLFHINHFILLLNYLYQHLIITYKLKGRDIHD

SEQ ID NO: 4077 - protein, 341 aa, Staphylococcus epidermidis
KGDYVMISKVEHQRHGLDLIKIDNDDTKIVFTNYGARIVSWKYHDNNIVLGNVVEADEFYFEEPFNFGATIGRYAGRIENASFKLDDDTFQLESNDGQHHLHGGSHGLNRRIFDYEIVDDIGQVKIIFTTTIKEEEDNYPGDMMVKVIHTYDANHRWSVQYEAKSTKKTVFNPSNHVYFNLNRDNNVVYNHCINSSALKMYMLNNKHIVKEGQSLDLHRLLDTNKVYLKDIFESDNETLQQQINHYNGIDHPFEFGGNELTIDNSEFELNIKTDMPHFVMFTFNDPQVWNNDFNIYKAHSGFSIETQYMPNDINMYGAKAQSILEADTLFTSKTSFQIHEK

SEQ ID NO: 4078 - protein, 75 aa, Staphylococcus epidermidis
ETKYFVKLNSFTPALNIVIILLGFTDLTKSKYEPFFKNFGENPAKGPNSNDFSPLTNRVSKCGTDIGGAPTSALP

SEQ ID NO: 4079 - protein, 110 aa, Staphylococcus epidermidis
GGRYMNVQFKKGALELIVLLIIKKEDQYGYSLVQNISRYMTIAEGTVYPLLRRLVKSGELSTYYQPSTEGPSRKYYQLTQQGAARVNQLEEDWKLFTEAVEHFIEESENE

SEQ ID NO: 4080 - protein, 324 aa, Staphylococcus epidermidis
FIKYEGVRKMTVTVRFQSLSQPLTLVSNVKEIPKDATIIWYDFENATDEENEYLKNHFDFNYLEIDDAINGDPRVKYIEYDAYQYMIFHSIINDDYSPISLSVFLEGNVLVTYHHKHFPSLKRVAQYNAENHDSELDCADIVIHILDCMVDKYFNFVYGIEDKVYNFEAKHVDDRYSKSVMENVFQLRSDLIKIKRVLFPMQEVVDTMKQEGNIIKDAKHRMYIQHIDDHLIKQRSVIRTSQEMTNEIRENYESFTSFRMNSIMQILTLVSVIFSPLTFIAGVYGMNFEFMPELKWHYAYFVCLTLMLIITIILIIFFKKKKWF

SEQ ID NO: 4081 - protein, 823 aa, Staphylococcus epidermidis
NRRYLYMLFGRLTERAQRVLAHAQEEAIRLNHSNIGTEHLLLGLMKEPEGIAAKVLESFNITEDKVIEEVEKLIGHGQEQMGTLHYTPRAKKVIELSMDEARKLHHNFVGTEHILLGLIRENEGVAARVFANLDLNITKARAQVVKALGSPEMSNKNAQANKSNNTPTLDGLARDLTVIAKDGTLDPVVGRDKEITRVIEVLSRRTKNNPVLIGEPGVGKTAIAEGLAQAIVKNEVPETLKDKRVMSLDMGTVVAGTKYRGEFEERLKKVMEEIHQAGNVILFIDELHTLVGAGGAEGAIDASNILKPALARGELQCIGATTLDEYRKNIEKDAALERRFQPIQVDEPTVEDTIEILKGLRDRYEAHHRINISDEALEAAAKLSDRYVSDRFLPDKAIDLIDEASSKVRLKSHTTPSNLKEIEQEIDKVKNEKDAAVHAQEFENAANLRDKQSKLEKQYEDAKNEWKNAQGGLDTALSEENIAEVIAGWTGIPLTKINETESDRLLNLEDTLHKRVIGQNDAVNSISKAVRRARAGLKDPKRPIGSFIFLGPTGVGKTELARALAESMFGEDDAMIRVDMSEFMEKHAVSRLVGAPPGYVGHDDGGQLTEKVRRKPYSVILFDEIEKAHPDVFNILLQVLDDGHLTDTKGRTVDFRNTVIIMTSNVGAQELQDQRFAGFGGASEGSDYETVRKTMMKELKNSFRPEFLNRVDDIIVFHKLTKDELKEIVTMMVNKLTHRLSEQNINIVVTDKAKEKIAEEGYDPEYGARPLIRAIQKTVEDNLSELILDGNKIEGKEVTIDHDGKEFKYDIHEITAKKETTES

SEQ ID NO: 4082 - protein, 387 aa, Staphylococcus epidermidis
WRLHTMKNSRFSGFQWAMMVFVFFVITMALSVILRDFQATIGVKRFVFSIKDLAPFIAAIVCILVFKHRKEQLAGLKFSISLKVIERLLLALILPLIILMIGLFSFNTYADSFILLQTSDLSVSLLTILIGHILMAFVVEFGFRSYLQNILETRMNTFFASIVVGLIYSVFTANTTYGVEYAGYHFLYTFMFSMIIGELIRATNGRTIYIATAFHASMTFALVFLFSEETGDLFSMKVIALSTTIVGVSFIIISLIIRAIVYKTTKQSLDEVDPNNYLSHIQDEEPSQEDASSTSNHDVSSKDETKQQDIDNDKHQSKKPNKSDDALTTSNYKEDASSVNKETDTTHNDNIKDHSTYTEDRHSSVVNDVKDEIHEVEDHKADTDKSH

SEQ ID NO: 4083 - protein, 228 aa, Staphylococcus epidermidis
ERKHMINCLIVDDDKKLLQYVSSHLERESIQTHTFTSGEASLDFLENKNVDIAIVDIMMSGMDGFELCQTLKDDYHIPVIMLTARDALSDKERAFLSGTDDYVTKPFEVKELLFRIKAVLRRYQINADNELQLGNLILNQSYMEITVGSKTMNLPNKEFQLLFLLASNPKHIFTRDDIIEKIWGFDYEGDDRTVDVHIKRLRQRLSKLKSSVSIQTVRGQGYRVDQNV

SEQ ID NO: 4084 - protein, 406 aa, Staphylococcus epidermidis
RNMHIVIGILGIIFFLALAVLFSSDRKNIRWRYVGLLLVIQLIFAFILLKTNLGISVIGSISDGFNYLLAKAAVGVNFVFGGFKFIDPKQPPFFFSVLLPIVFISALIGILQYTRILPLIINLLGFLISKINGMGRLESYNAVAAAILGQSEVFISLKKQLPYIPKQRLYTLTASAMSTVSASIIGAYFTLIEPKYVVTAVVLNLFGGFIIASIINPYKVNEEDDKLLIDENETKKQSFFEMLGEYILDGFKVAVIVGAMLIGYIAIIALLNGMVSGILSFMSGGAIQWNFQTLIGFIFAPFAFLTGIPWQDAVQSGSVMATKLLSNEFVAMQDLGKATGLSEHAKGITSVFLVSFANFSSIGIISGAIKSLNDEKGDVVARFGIKLLFGATLVSFISAAIAGFFI

SEQ ID NO: 4085 - protein, 236 aa, Staphylococcus epidermidis
RGEQRHMKDAKELKLMTLEDVLSQIENGMTIGIGTGSTIELLIPQIAELIQQKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIERTYDIHVSRRVNEDVPFITDNGNYILDCSLQNRIPAYELHEFLIHLTGVLETGYFLDIADQVIVGTQEGVKILNKET

SEQ ID NO: 4086 - protein, 145 aa, Staphylococcus epidermidis
KTEQNFYMKGGVLVLKIMSKHSATLVIMFLITLLPIFQYQASAHATLEKSTPQQQGVIKDKPEAIKLEFNEPVNTKYSSVTLFDDKGKKIKDLKPITTGWSQTVVFSSEQIVNGTNTIEWHTVSADGHEVGDTFEFSVGKVRLKM

SEQ ID NO: 4087 - protein, 134 aa, Staphylococcus epidermidis
IMTKIHFEAPSPEDYCNLRANAGMSSKSIEAAIKGLPHACFNVTLYENDMLIGMGRVIGDGGTVFQIVDIAVKDIYQGLGHGMTIMHEIMKYIESVAEEGTYVSLIADYPADQLYEKFGFKSTEPYSKGMYIKY

SEQ ID NO: 4088 - protein, 66 aa, Staphylococcus epidermidis
TKYKCLPQSITQKTKINIQSYIFGVQHKSVIELTLLQIGGLNEYDKIVCHSCLYNSNMYCLCNLIT

SEQ ID NO: 4089 - protein, 61 aa, Staphylococcus epidermidis
MKYKTTFKIKPPFTPAKDLAIFSKIITKTLSKLLLKKLVNVLHQLDKLILTFITKLNLNKI

SEQ ID NO: 4090 - protein, 71 aa, Staphylococcus epidermidis
VNSNTNDTPCINMGNTKRGVLKSSLKLISIVPMLLLSLRLFSSDSGTLNKVPINMTIPNIVSITNTIRHGP

SEQ ID NO: 4091 - protein, 537 aa, Staphylococcus epidermidis
GEFNMLVESFNPFGNLLLSSLIAAIPIILFLLCLTVFKMKGIYAAITTLVVTLLIAIPFFKLPVGIASGAVVEGFFQGIFPIGYIVIMAVLLYKITLKSGQFATIQDSITSISQDQRIQLLLIGFSFNAFLEGAAGFGVPIAICALLLAQLGFRPLQAAMLCLVANAASGAFGAIGIPVGVVNTLNLPGHVEAMGVSQTSTLTLAIINFFIPFLLIFIVDGFKGIKETLPSILVVSVTYTVLQGLLTVFNGPELADIIPSLASMLALALFSKKFQPKNIFRVQKDVKPEAPKKLKGKEILFAWSPFIILTVIVMIWSAPSFKALFAPKGKLSALVANFDLPGTFSNISHKPITLSLNLIGQTGTAILITIIITVLMAKKVNFGDAGRLFVEAFKELWLPIITICFILAISKITTYGGLSNAMGQGISKAGSVFPILSPILGWIGVFMTGSVVNNNSLFAPIQASVAQQIGTSGSLLVASNTAGGVAAKLISPQSIAIATAAVKEVGKESELLKMTLRYSIGLLVFICIWTFILSFIL

SEQ ID NO: 4092 - protein, 74 aa, Staphylococcus epidermidis
NNPNKLEELPLAPLLSSIAIENPNVAIPVTGATKITKPQESIQKVQWLSKVSDTIITPITCIVDMILSNSNLSI

SEQ ID NO: 4093 - protein, 214 aa, Staphylococcus epidermidis
RCVNKKYTNIFNNCVGLQFIYLNFLFDLGEYMKQRAKYKIIKSLIELLEYYPFDEITIKMICAYSGVNRSTFYDHFQDKYQLLDKIQNYHLNKYISLLQSFYNDFHHIKTDQKKLYKFFLLIAKYIKRKEAFYRATLVTYPNKDIALDYINATKTCYEKVMNRYETSINNKRMFIIYSVGGQAGVFIDWLRNGCIESPQEVAQVLLANTIKLQR

SEQ ID NO: 4094 - protein, 231 aa, Staphylococcus epidermidis
MAKKGKKYQEAASKVDRTQYYSVEEAIKLAKETSVANFDASVEVAFRLGIDTRKNDQQIRGAVVLPHGTGKSQRVLVFAKGDKITEAEEAGADYVGEADYVQKIQQGWFDFDVVVATPDMMGEVGKLGRVLGPKGLMPNPKTGTVTMDVKKAVEEIKAGKVEYRAEKAGIVHASIGKVSFDEEKLVDNFRTLQDVLAKAKPASAKGTYFKSVAVTTTMGPGVKVDTSSFKL

SEQ ID NO: 4095 - protein, 186 aa, Staphylococcus epidermidis
MNKNDYLKELKKHLKHMNKEEKEDILNEYDTHFYSGQQEGKSESDVCKELGNPKLIGKELTATSSVENAHQKVSLMNISSAIVAVMGLSLLNFFIVIIPAFLCILLVLTFIIFTLASLAAPLMLLIKGIMDGFHSIILYDAFMTGLMFGVGLVLAVVTYYLIKWLFDVTMKYLKWNISIVKGSVQS

SEQ ID NO: 4096 - protein, 320 aa, Staphylococcus epidermidis
LIKNQGGYIMYQLAQSNLWTGRLDSETDPTQFRHFQTVKFGDLSQLDFSDEHKGVGLLGYAIDKGVELNKGRVGAKEGPNAIKRAFAGLPDLNQCEEIIDYGNVEHNHELLIDTQREFADLAAKSIKRHKQTFLLGGGHDIAYAQYLATRKVYPESSIGVINIDAHFDTRDEGYSTSGTSFRQILEEDDNADYLVLGISQGGNTQALFNYAKEKDIQFVYADELLHQVSPPIKDMIERFIHNHDTVMFTICMDVVDSAFAPGVSAPAVLGIYPHTVFELAKRVIPSEKVKSISIAEMNPTYDSDQRTAKLVANLVHHCLI

SEQ ID NO: 4097 - protein, 300 aa, Staphylococcus epidermidis
LMKNRMMNRVVNKYILHNRSIFFSNDDEVKHFLEKRSIENSKKHQQPATLNVKSNLDKLTLNDMQVFRFNFRHEKNQKILYLHGGYNTLQPSPFHWRLLDKLTLNTLHEVVLPIYPKSPDYHYLETFKAIRDVYNQLVEEVGANNIVMMGDGSGGGLALSFVQSLINDNQEVPRKLFLLSPLLDATLTNPNITKTLEENDILVSRFGVHQLMKSWTNDLPLSDARISPLYGTLKGLPPIYMYGGGREILSPDMHAFTHALEECGNDVEFKEYPKMVHDFPIYPIRQSHKVLKHITKSILE

SEQ ID NO: 4098 - protein, 192 aa, Staphylococcus epidermidis
VRCLKLLCENCHFNEAEVKLTVKGIDSTHEKWVCSVCAQGENPWLHSNDDNTYHTHQDDIEEAFVVKQILQHLAAKHGINFHEMAFKEEKKCPTCQMTLKDIAHVGKLGCADCYATFKEDIIDIVQRVQGGQFEHVGKTPQSSYKKLAIKKQIEEKSKYLNKLIDGQEFEEAAIVRDEIKALKSESEVSHDE

SEQ ID NO: 4099 - protein, 205 aa, Staphylococcus epidermidis
LIVKKIKAETLSDMQNYKLLSGSIIPRPIAFVTTQNLKGDINAAPFSFFNVVNHTPPMIAIAVQRTKGNRKDTSINIEQSGEFVVHITDEAIVNDVNETAAPLEYGVNELKRTSLSMIDSDLIKVPAIKEAKVRFECKLHQIVQLGNKDNGSDLIIGEIVVYHIDEEVYFEDSKIDANQLNPVARLAGNDYSLLGQTFTVNRPTS

SEQ ID NO: 4100 - protein, 240 aa, Staphylococcus epidermidis
YYALFNILIEIQFNMIKRQSRRRFQMKKVLASATILSLMLVGCSNGGNDESSHKDDSSKTEQKDKSSSQHDSKKDSKRNDTNNKQDNQENNTNKEQTNNQNPNDGEQRTSERPTTNSNGNSSDNQNKQQQSVQDNQNKYVAPYQSENATRVARCLSPFEGDRSQALQQLPNFETALSIAKNEANMYGSENKSYNDYSIEQTEDGFRYVFSFKDPSKSNTYSIVTLNRQGQPTVVDPNFQP

SEQ ID NO: 4101 - protein, 359 aa, Staphylococcus epidermidis
HIKKWERISMNLAWKEIKFYKFRFILIMFIIFLMAIMVLFISGLAQGLARENISIFDQIKGNQFVVQKMKEPQLEKSILSRSKQDNISKIIDEKPFKMAGKTFKINGNEENVMAINSVKNHQPNLKSGHYPKNGNQIAINEKLTAEGLYLDDKVKVKGDDTTYKVVGILKNTMYSHSNIVMMDQSKIEQSSNVATFYVTNQLSKSDKNKINHIKGVQTATTDNITSNIASYKAEQTPLDMMIISLYIITAIVLSAFFYVMTIQKTSEIGILKAIGITTKHLLTSLILQISMITFIGVAIAEVVILLISQILPVSMPFHIDMHNIIIVLVIFMIVGLIGTSLSFIKLIKIDPIEAIGGGQ

SEQ ID NO: 4102 - protein, 378 aa, Staphylococcus epidermidis
ERAERYMTNYSTYVDWRRTFHQYPELSDEEYETTDKLRKILKSYGIRILEVPLKTGLVAEIGQGEEMIAVRTDIDALPIEEQVKHEFTSKYQGAMHACGHDIHMASILATGIQLKEIEDELNGRVRLIFQPAEELGHGAFEIINTGVLKGAKAVLGFHNYPTLKVGEFAIKSGAITSAVDRFEFNVKGKGAHAAKPEQGNDPVIVVGQLINSLQTIVSRNLSAFDSAVVTIGEISCGNTWNVIADKAYIQGTVRSFDEDIRHYIENRMKNIADGLSRVFNVDIDLTYSRLPGAVVNDAHLTQEAIEVAKNVGYHVSMLDEPVTIGEDFSGYTEEYPGVFAFIGSDSKYDLHHPKYHPDERILEKVPQYFVQLVQRLLT

SEQ ID NO: 4103 - protein, 286 aa, Staphylococcus epidermidis
CDYEISKMEYLYCQRKCTIMKKIAAIIFLIGLSLIIICSVGVYAQNKKLSKDNQYNNQTTNLMKNYDDNTVKSIYIDGKVSDITVKKGKHFSVKSKGNDKNLNVTSKVNNQRWVITERQTSPHINFRIQGKVSNHITITVPKYIKNIDIKTNAGDLNIVGVNSGTGRFDAESGDIKVQKGRYKKVTLHNEDGDIHTKDIHFNQANIQNDNGDIQMKQLDPDIPLRIKNEEGDINLNYKKELHHTQIITRNEEGETDIDHRVLYNSKVENGNNKVKLINENGDIKVK

SEQ ID NO: 4104 - protein, 397 aa, Staphylococcus epidermidis
CYNDLNIIENNEVFYAMKSFTFFMHNIYAMGGTVKSVTQLANTLAEKGHPVTIISVFRGADSPYFELHSAIKVKVVVDYRLKLKNTRAITANRIKKYTPFLNTKVISQFEPGKSQFSSYVEKKMIKAIRHTKTDVLVGTRASFNILISKYAKAEIVTIAMEHMNFDAHPDQYQKEIIAAYRNINKITTLTVADQQKYQSQLKTPVYVIPNMVTEKRIAAPKKNRIISAGRLEYEKGYDLLLESIRLIQEDLRQLNYDVHIYGSGSKKTSLVDFINQYHLNDLIKIYEPTQELNNKLAQSKIVVVPSRNEGFGMIILEAMVQDNIVISFEGNVGPDSIINNGDNGYLVNYENVSELAKRIDLTTQHYNELDHIIENSKDTLKQFSPDHIYQLFMSMFK

SEQ ID NO: 4105 - protein, 187 aa, Staphylococcus epidermidis
VRSEDMSEEVGAKRWYAVHTYSGYENKVKKNLEKRVESMNMTEQIFRVVIPEEEETQVKDGKAKKLVKKTFPGYVLVELIMTDESWYVVRNTPGVTGFVGSAGAGSKPNPLLPEEVRFILKQMGLKEKTIDVELDVGEQVRIQSGPFANQIGEVQEIEADKFKLTVLVDMFGRETPVEVEFDQIEKL

SEQ ID NO: 4106 - protein, 69 aa, Staphylococcus epidermidis
KVIECGGLMMAKKESFFKGVKSEMEKTSWPTKEELFKYTIIVVSTVIFFLVFFYALDIGINALKQLFLG

SEQ ID NO: 4107 - protein, 460 aa, Staphylococcus epidermidis
EVKDIGWTKMFKTLYSRIAIYAITVILFSALMSFLFTNIYYHFHLKASNDAKIMRTLKEAREYERTQKPKPLDTYLKHLGQMNYQIMTVNEHGTKHFYGETFRKNTISQSAIKKVLNGEDYHGIKNKPYAFFVTGFFDNETDNTVGIQFKTDDGALAVFMRPDIGETFSEFRIFLAVLITLLLIISISLVIASTYSIIKPVTALKNATTRIMKGDFSTPIKQTRHDEIGTLQSRFNTMRQNLGQVDQMRQHFVQNVSHEVKTPLTHLQRLLTQLELTQNEEEKQLCINEMFEITNQVSELTKELLLLSELDNASHLTFNDNVHLNTLIKDIIRHEQFRTDEKDLVMFTELEDLYFRGNERLLHQAFNNLIINAMNYAPQNSMINITLTSTNHLIIFNIENDGSIAEEDAKHIFDRFYKLSDESSSNGLGLAITQSIIHLHHGSITLTSDDKTQFIVKLFI

SEQ ID NO: 4108 - protein, 219 aa, Staphylococcus epidermidis
TEGETFVLKRMRDDIKMVFEQDPAARSTLEVITTYAGLHAVWSHLIAHKLYKNRRYVAARMISQLSRFFTGIEIHPGAKIGKRLFIDHGMGVVIGETCTIGDNVTIYQGVTLGGTGKEKGKRHPDIGDNVLIAAGSKILGNIKIESNVNIGANSVVLQSVPSYTTVVGIPGHIVKQEGRRIGKTFDHRNLPDPLYEQIKHLERQLEKAKNGEIQDDYII

SEQ ID NO: 4109 - protein, 292 aa, Staphylococcus epidermidis
IFSWKSEAKDVDTSSPFYEKSKFWFGLLRYVTEGANFLLIGLFWLNGIARKRGLRQFNVLPKQSGIAWIMAMSLLVSLVVYMMTLTSDILEDILSFKLEVIMQFPYILSSISLIILFILFILKDMEKIWYWLISIVMIAVISMSGHVWSQQVPLWSIIIRTIHLIGLTLWLGSLVYLICYAIKVKINQLTSVRRMLLKVNIIAVIMLVFTGILMAIDETNTLTLWNNVSAWSIYLVIKIAGIIAMMLLGFYQTMRALRQRQQVHRFALMTELLIGMILIFAGIMMSQINIPS

SEQ ID NO: 4110 - protein, 168 aa, Staphylococcus epidermidis
RSFRHEMFKSGRAKLSPVTTSRYQGVHIVAKKVEKVVKLQIPAGKANPAPPVGPALGQAGVNIMGFCKEFNARTQEQAGLIIPVEISVYEDRSFTFITKTPPAPVLLKKAAGVEKGSGEPNKTKVATVTKDQVREIAQTKMQDLNAADEEAAMRIIEGTARSMGITVQ

SEQ ID NO: 4111 - protein, 75 aa, Staphylococcus epidermidis
HLLLEALSHGSTLHLIAILIFDLLLFSSQLFIFINKGAFINIYDVLTATAHSLTHKHLTTNPLNHFIFIIICCHL

SEQ ID NO: 4112 - protein, 179 aa, Staphylococcus epidermidis
MGERIRSVQITEVEQLQLIAKRTFFTTFRESYSDEDFKQFFSDAYDIDVLRKELEQSNSFHYFYEVDQNIVGFLKLNINDAQTENKGHAYLEIQRIYFDEAFQGSGRGQLFINLAIDQAIKFGKSKIWLGVWEHNPKALSFYKNRGFRVTGSHQFYTGSVVDNDLIMELDLTTNYKQSL

SEQ ID NO: 4113 - protein, 229 aa, Staphylococcus epidermidis
SYWRWPIMGLVVKDISKTFGEKTSKTEVLKDINFEVKDGEFIILNGASGSGKTTLLTILGGLLSQTSGDVVYEGKSLFERHTNKAHLRLNDIGFIFQASHLVPYLKVLDQLTLIGKETGMSSKEAQARAKELLKKIGLEEQLNSYPHMLSGGQQQRVAIMRALMNHPKIVLADEPTASLDASRAQEVVEMIRKQIKANQMIGIMITHDESLFKYADRIVQLYDGKIKNS

SEQ ID NO: 4114 - protein, 243 aa, Staphylococcus epidermidis
VLFGHIKKQREPKGLHKVILTVLDNLLTPLLSIFITAFITFLFVGPVTRQLGYWLSDGLTWLYEFGGAIGGLIFGLLYAPIVITGMHHIFIAVETTLIADATKTGGSFIFPIATMSNIAQGGAALAAFFIIKQNKKLKGVASAAGISALLGITEPAMFGVNLKLRYPFIGAVAGSGIGAAYISFFKVKAIALGTAGLPGFISINPTHAGWLHYLIGMLIAFVVSVVVTLVLSRRKTNKTAVES

SEQ ID NO: 4115 - protein, 501 aa, Staphylococcus epidermidis
LIFGYLLSTQLIVGVKIMSERIRVRYAPSPTGYLHIGNARTALFNYLFAKHYNGDFVVRIEDTDSKRNLEDGESSQFDNLKWLGLDWDESVDKDKGFGPYRQSERAEIYNPLIQQLLEEDKAYKCYMTEEELEAEREAQIARGEMPRYGGQHAHLTEEQRQQYEAEGRKPSIRFRVPKDQTYTFNDMVKGEISFESDNIGDWVIVKKDGVPTYNFAVAVDDHYMQISDVIRGDDHVSNTPKQLMIYEAFGWEAPRFGHMSLIVNEERKKLSKRDGQILQFIEQYRDLGYLPEALFNFITLLGWSPEGEEEIFSKEEFIKIFDEKRLSKSPAMFDRQKLAWVNNQYMKTKDTETVFELALPHLIKANLIPENPSEKDREWGRKLIALYQKEMSYAGEIVPLSEMFFHEMPELGKDEQEVLQGEQVPELMNHLYGKLESLESFEATEIKKMIKEVQKETGIKGKQLFMPIRVAVTGQMHGPELPNTIEVLGKDKVLSRLKNLV

SEQ ID NO: 4116 - protein, 256 aa, Staphylococcus epidermidis
WMKGSVNVEDIVIVGRHAVKEAIISGHAINKILIQDGIKKQQINDILKNAKSQKLIVQTVPKSKLDFLANAPHQGVAALVAPYEYANFDEFLQKQKKKARYSTVIILDGLEDPHNLGSILRTADASGVDAVIIPKRRSVALTQTVAKASTGAIQHVPVIRVTNLSKTIDELKDNGFWIAGTEANNATDYRDLQADMSLGIVIGSEGQGMSRLVSDKCDFHIKIPMVGHVNSLNASVAASLMMYEVYRKRHQLEEKS

SEQ ID NO: 4117 - protein, 476 aa, Staphylococcus epidermidis
EIEGRFMIKQINISNMDKLKEQMERALSDGYTHVIPYSNEIQIHQSMIKAITLPKTSFIVDYTINNYYLNDCKYFGLDFVDFEDWVKNINLYPNVIYEINSTLELIDKFEVENIFDLALLTILKGHIAVEGHVVLDFKGPLKTSKGFWRSFDRNDLTYRDKFFLNTIAYAHKQRIPFTRVPFNDHDSIRYYDSVLLSTKFKAPRWLVTPIKNYSVKKHKEISYIYKKDSSKLKNHVVFLGFDFGYRGNSKYLFNYFVKHNPMIESYFITDERTGPHFISTNDENVKNLIETATFVITESYIPDDIHPNGKIIQLWHGTPIKKLFLDSKEPHQNLNIYNYRARKYNKWTQQDYLIVDSEESKTYFESAFPSQKIDILPVGYPRNNYLLNRINDVGLHKRIFSEINIDPTKRVLLYAPTWKTNSSDDDIFPINEQLLTHYNVIYKGHVESKNDLVPEGVINPPNNIETQDLIIISDVV

SEQ ID NO: 4118 - protein, 60 aa, Staphylococcus epidermidis
KFYMLAPTLIIISMIHITVELHMQRCTIVSTLTCLFISTLITVSLIQIKRLKKDNNLNQI

SEQ ID NO: 4119 - protein, 62 aa, Staphylococcus epidermidis
KPSIIPLMSNINGAASEARVKMMKVNTSKMHKKAGIITIKKLSKLSPITATIADEIFINDTF

SEQ ID NO: 4120 - protein, 114 aa, Staphylococcus epidermidis
KGNITKITWTATDKGIGPHEFIEFPIVVANPKKEGTFKWNTTQTYDNGDVVKWTGKEDSAHPAPTTTVKKGANPNDTHSDSSQGDSIALWIVAIVAIVISLIALFKQAHPKKFN

SEQ ID NO: 4121 - protein, 352 aa, Staphylococcus epidermidis
GVLMSDSQREQRKNEHVEIAMSQKDALVSDFDKVRFVHHSIPSIDVSQVDMTSHTTKFDLAYPIYINAMTGGSDWTKQINEKLAIVARETGIAMAVGSTHAALRNPNMIETFSIVRKTNPKGTIFSNVGADVPVDKALQAVELLDAQALQIHVNSPQELVMPEGNREFASWMSNIESIVKRVDVPVIIKEVGFGMSKETLQALYDIGVNYVDVSGRGGTNFVDIENERRSNKDMNYLSQWGQSTVESLLESTEFQDRLNIFASGGLRTPLDAVKCLALGAKAIGMSRPFLNQVEQSGITNTVDYVESFIQHMKKIMTMLDAPNIERLRQADIVMSPELISWINQRGLHLNRK

SEQ ID NO: 4122 - protein, 133 aa, Staphylococcus epidermidis
RRIIMSIKEKLVIELMNLKDTVKYELSELNEQQYLFMNGPAPQLMKRAMKMSYILGQKEAIDHFLLLIDTCHENVLLDNCQDYQKQIQHKQFSLQEDIIHQINQSKEFESFLSTYYVNKGKYDITSKIKTLLE

SEQ ID NO: 4123 - protein, 154 aa, Staphylococcus epidermidis
EIKMVRRIEDHISFLEKFINDVNTLTAKLLKDLQTEYGISAEQSHVLNMLSIEALTVGQITEKQGVNKAAVSRRVKKLLNAELVKLEKPDSNTDQRLKIIKLSNKGKKYIKERKAIMSHIASDMTSDFDSKEIEKVRQVLEIIDYRIQSYTSKL

SEQ ID NO: 4124 - protein, 231 aa, Staphylococcus epidermidis
KVVIYMIKVNAISIGKIETLSYGNYKPMQSALNKIPFKGQMWLNRLGFVDDEQAYHNHGGIHKAICCFSKSNYQLFKDDLDQLPEFAMFGENLTVEHLDEADVYFGNQYQLGDTIIEVSDIREPCWKIQAKYAIPNLVQKMSQSGKTGFYFRVIKEGYVHQSDNLKLIKKAESNTRLSVKDLNHLFYNERNNLRLIYHALRNPYLSPDRKKKLQKMKTRAENRKFIKSDDK

SEQ ID NO: 4125 - protein, 471 aa, Staphylococcus epidermidis
CSEMSRGDKMSQCPNCGHQVKDDTSQCPNCGQLLTKKKKRKIKDQSSQSSNENSTNIRLRKIVPIGISVFILILIIVLFFLLRNYNSPNAQAKILVNAVDNNDSQKVATLLSTKNKKVDDVEAQQYINYVKKEVGIKKYIQDINNTVDKLNKSNSSVASYIQTKSGQDVLKISKNGTKYLIFDNMSFTAPTKKPIIKPKVETKYEFRTSGKKKTVIAEANKNTPLGEFIPGTYHLPAKKITENGTFNGHLNFDFRESHSETVDVAEDYDQSFINIKFKGANKLSDKSEKVQINDRTFTYSHSKEFGPYPKTKDITISATGKAKGKTFSSETKTISADDLKDNTKVTLEFDSDKINSYVEKKEKEENSLKNKLTEFFTGYATAMNSAFNMNDFNFISSYFKKNSSIYTSMKSNFQNRTNVTMISPQVLSVHRNGHTVRTTIQHIDHIGNYINKDYELEIDNDDSNMQLVKEL

SEQ ID NO: 4126 - protein, 462 aa, Staphylococcus epidermidis
IGGVSMAKKKVIFECMACGYQSPKWMGKCPNCGAWNQMEEIVEKVAHPKHGVKTKETAGKVQKLNSVKHEATPRLLTESKEFNRVLGGGIVSGSLVLIGGDPGIGKSTLLLQICAALSQNKNVLYITGEESINQTKLRADRLEEDSSHLNVLAETDLEVIHQTVKEERPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVLNPSEMFLEERSTNVPGSTIVPTMEGTRPLLIEVQALVTPTTFNNPRRMATGIDHNRLSLLMAVLEKKENYLLQQQDAYIKVAGGVKLTEPAVDLSIIVATASSFKDQAVDGLDCFVGEVGLTGEVRRVSRIEQRVQEAAKLGFKRAIIPQTNIGGWTFPEGIQVVGVSSVHEALKYALHSKQR

SEQ ID NO: 4127 - protein, 135 aa, Staphylococcus epidermidis
DLNVAKHMNVKLLNPLTLAYMGDAVLDQHVREYIVLKLQSKPHRLHQVSKSYVSAKSQAKTLEYLLDIDWFTEEELSVLKRGRNAKSYTKAKNTDIQTYRKSSALEAVIGFLYLDHQSERLENLLETIVRIVDER

SEQ ID NO: 4128 - protein, 479 aa, Staphylococcus epidermidis
KDSLKKLRMERFKMITLYNTLTRRKETFEPIEPGKVKMYVCGPTVYNYIHIGNARPAINYDVVRRYFEYKGYEVIYVSNFTDVDDKLINRSKELNESVPEIAEKYIKAFYEDVGALNVKKATSNPRVMHHMGEIIDFIKELVDEGYAYESDGDVYFRTRQFDGYGKLSHQSLDDLKVGARIEAGEQKEDALDFTLWKKAKPGEISWNSPFGKGRPGWHIECSVMAYHELGSTIDIHAGGSDLQFPHHENEIAQSEAHNHAPFANYWMHNGFINIDNEKMSKSLGNFILVHDIIKEVDPDVLRFFMISVHYRSPINYNLELVGAARSGLERIRNSYKLIEEREQIASDLEEQSEYIQQIDKILNQFETVMDDDFNTANAVTAWYDLAKLANKYVLENTTSTKVLNRFKEVYSIFSDVLGVPLKSKETEELLDEDIEQLIEERNEARKNKDFARADEIRDMLKARHIILEDTPQGVRFKRG

SEQ ID NO: 4129 - protein, 183 aa, Staphylococcus epidermidis
TSSVRGKVMKKRYLIIDGYNMIGQSSTLSTVAKENLEEAREQLLDTIANYNALIADEIVCVFDAYEQSGIEREYFYHGVKTIFTKEKETADSFIERYVYELYNKHTTHITVVTSDMSEQHAIFGSGAYRISSREMWRELKENEVVVNKSLDDFSEKKPRIRIPLSNEILEEFEKIRRGNQKKD

SEQ ID NO: 4130 - protein, 408 aa, Staphylococcus epidermidis
KGGVSLKRVYQSENQSLLFIVILGSLTAFGPLAIDMFLPGLPNISHDFDISASTTQLTISFFMIGLALGNFLAGPISDITGRKKPLIFSLIIFTIASLGIIFVTNIWIMIILRFIQGLTGGAGAVISRAIASDMYSGNALTKFLSLLMLVNGIAPIIAPALGGIILNYGPWRIVFVILTMFGIVMLIGTLFKVPESLEKSLRESSNIGTMLINFKELFKTPRFVLPMLIQGVSFVLLFTYISASPFIVQTIYGLTPLNFSIMFAFIGVTLIISSQLTGKLVDYIDRLLLLRIMSTIQVIGVIIVSLTLLNHWTFWILSCGFVILVAPVTGIATLGFSIAMDESKGAKGSSSSLLGLFQTLLGGVISPLVGIKGDSNAIPYIIVIVITAIILMVLQLINVKIFKKAKIH

SEQ ID NO: 4131 - protein, 163 aa, Staphylococcus epidermidis
SKKVKKEVISMHNMSDIIEQYIKRLFEEADEDVVEIQRAHIAQRFDCVPSQLNYVIKTRFTNEHGYEIESKRGGGGYIRITKIENKDATGYINHLLQLIGPSISQQQGYYVIDGLLDKGLINEREAKMIQTIIDRETLKMDVVARDIIRANILKRLLPVINYY

SEQ ID NO: 4132 - protein, 208 aa, Staphylococcus epidermidis
KREVIYLDFINQQTTQTAKALLGVKIIYQDDYQTYTGYIVETEAYLGIQDKAAHGFGGKITPKVTSLYKKGGTIYAHVMHTHLLINFVTRTEGIPEGVLIRAIEPDEGIGAMNVNRGKSGYELTNGPGKWTKAFNIPRSIDGSTLNDCKLSIDTNHRKYPKTIIESGRIGIPNKGEWTNKPLRFTVKGNPYVSRMRKSDFQNPDDTWK

SEQ ID NO: 4133 - protein, 320 aa, Staphylococcus epidermidis
KELLIMITAYKHALHHPSQIIETEINHSASWINVVEPDREEIEGLMEFYNIPEDFIRDPLDSEESARIEYDEDTGYSLIIIDLPIVNSTNRRVLSFVTIPLGIIIGNGIVMTVCDAENEFLENFAKQEDINLKFHSRFALEILTTIANHYNRNLRLLNKSRIRIERELKNNITNKQLFKLMEVEKSLVYFLAALKGNDTIIKKLFRLPAIKRFEEDEELLEDLVIENNQAIETTELHQRILESITSSYASLLSNDMNNIMKTLTLFTVLLTLPTLVFSFFGMNVPLPIDDHSYVSWIIVVGISLILVAIVSIFLWKKQKL

SEQ ID NO: 4134 - protein, 219 aa, Staphylococcus epidermidis
EGIFMKKMILINVITIIVLVVIGVLGFWFWHNTTSYVTTDNAKVDGDQIKISSPASGQIKSLNVKQGDKLDKGDKVAEVLAQGQDGQSKDMNIKMPQKGTIVKTDGIEGSMTQAGNPIAYAYNLDDLYITANVDEKDISDVEKGNDVDVDIDGQKASIKGKVEEVGQATAASFSLMPSSNSDGNYTKVSQVVPVKISLDSNPSKNVVPGMNAEVKIHKN

SEQ ID NO: 4135 - protein, 410 aa, Staphylococcus epidermidis
VLVLFSGDFTTMPLNVAITITVIVALLMNRKETFAKKVEVFTKGAGHSNIILMMLIFILAGAFSTTAEKMGGVSSTVNLGLSLIPQNLIIVGLFIICMFVSISMGTSVGTVAAIAPVGFGFAQATDVPAALAMATVVGGAMFGDNLSMISDTTIAAVRTQKTKMSDKFKVNFKIVLPGAIITIIILFFLTNGISIDHTKNYDYNLIKVIPYLLVLILALVGINVIIVLIGGTVLAGIIGLIDGSFGWNGLLNAISKGIIGMEDIAMIALLIGGLVGIIQHNGGIDWLLNFVRSKVKSKRGAELGIASLVSAADISTANNTISIIMAGPLAKNIADEYDVDPRKSASILDIFGGCFQGLLPYSPQVISAAGVAGISPFLMLQYSIYPILLGVCGLVAIILRVPRLNQSSKK

SEQ ID NO: 4136 - protein, 142 aa, Staphylococcus epidermidis
GGFFMRRLLYSFLFYMVIGLLSGFYYRELTKAHDFVGDTQLSLVHTHTLILGMFMFLLLLPLEKVFKLSSYYLFNWFFFVYHLGVLITISMMTVKGTFQVIGKKFSPEMFAGFAGIGHTGMLAGLLLLFFLLRQAILTEPKK

SEQ ID NO: 4137 - protein, 94 aa, Staphylococcus epidermidis
CKTLTNFLSKSLLSVLVIIFEKIARSLAGVKGGFILKVVLYFIYFFVAFFVVDSLISLVFPIEFDVYTNLITAFIFAVFMTPLLFVLKQDKNKK

SEQ ID NO: 4138 - protein, 402 aa, Staphylococcus epidermidis
MIEFDAITTLCLACVLYLIGQTIINHVSILRRICIPAPVIGGLLFAILVAILDSFNIVKIKLDSAFIQNFFMLAFFTTIGLGASLKLFKIGGKVMLIYFTFCGIMAICQNIIGVSLAKLLNIKPLLGLTAGSMSMEGGHGNAAAYGKTLQDMGVDSAVAAALAAATLGLVFGGLIGGPIVKYLIKRYDLKPEHRDDSFKNYGVVEYNQSLHTKYKPIQVFFIQFSILVFCMALGTYIGNTFTDLTGVNIPMYVGSMFVAVIIRNATDFIGWDIVDLKMSEQIGDISLGIFLSLALMSIQLTQIYSLAIPLIIIVLVQVVFMVLFSIFILFKGLGKDYDAAVMVGGFIGHGLGATPNAMANLDVITKKFGNSPKAYLVVPIVGAFLIDLIGVIIVMSFIQLFS

SEQ ID NO: 4139 - protein, 71 aa, Staphylococcus epidermidis
SSYSSRYTLGYLYRLNNFFKIKPLTINYRIYLHILIVVIVIILLMYNLQSILINIWLFIIHTINSRSENNE

SEQ ID NO: 4140 - protein, 62 aa, Staphylococcus epidermidis
TVHSYIYLLSRINSIKLYTVVIQINYSIHYYTLQGTEFNLLIHTSLFKLHHLLLTNYKNQYF

SEQ ID NO: 4141 - protein, 315 aa, Staphylococcus epidermidis
LDTSKGQSSMEEVLKLKIPASTANLGVGFDSIGMALDKYLHMSIRKIERANWEFLYYSSELEGLPKDENNYIYQTALNVARKYNVTLPSLQIEMRSDIPLARGLGSSASALVGALFIANYFGNIQLSKYELLQLATEIEGHPDNVAPTIYGGLIAGFYNPITKITDVARIEVPHVDIILTIPPYELRTEDSRRVLPDTFSHKGAVQNSAISNTMICALIQHKYKLAGKMMEQDGFHEPYRQHLIPEFNQVRKLSRQHDAYATVISGAGPTILTLCPKEKSGKLVRTLREKINNCASELVTINEIGVKDEVVYLKS

SEQ ID NO: 4142 - protein, 292 aa, Staphylococcus epidermidis
VVMSLTIILSIIIIILIMAMVLNQKFMKDRVETEEYARNQLISKNSILSEENLSLKNQMLSTNNDVGQHAFKNAKRELRKILNRFKEEGRLRSYTIVPTSNLAVKHPLFEYARSFDFIIITDVGLINVDVKNWNQKTFYHFDVPDQHLEEGQPQYNTEKVVGHYISNRYHSQFKTTRSGVYTFIEILQDNRVIYEFYDHDPYDKAANNAKALKDKIENDYNFKIQSIGVIYFSDGSVNIIEGSDESDKYVDTVSTPISLEKVIEEAIDLSKHPLTDKQIEEISENFKQHMNN

SEQ ID NO: 4143 - protein, 70 aa, Staphylococcus epidermidis
YMMLGVKEMDTSNENKITIIAVIVAIIVGVVLQIVFKLPLIVSLVGSVFLGMFVGFIVYLIQSFRRKKKN

SEQ ID NO: 4144 - protein, 62 aa, Staphylococcus epidermidis
IPELAADNNDVKITALMTDAAKAIPILSKTIVNGLCDTDSFSLSKSGSVYGMMAAITAIDNT

SEQ ID NO: 4145 - protein, 183 aa, Staphylococcus epidermidis
NKVTLLKSKKMSSLLVVAMIGILVIIFQFVNHSGPFSGSESQHQSDNSNLNGKDKVYVKRVVDGDTFVAQKNGEEIKVRLIGVDTPETVKPNTPVQPYGKQASNYTKKYLTHQNVYLEYDKEKTDRYGRTLAYVWLKNGDMFNESLVKKGLAREKYFSPNGKYRDTFVHAQEEAKKRKLNIWS

SEQ ID NO: 4146 - protein, 448 aa, Staphylococcus epidermidis
PLIYIFSTVQLFFSKAQTEVIYMKELNIALLGLRTVGSGVVKIIEENRQQIKDTINKDIVIKHILVRDKSKKRPLNISQYHLTEDINDILNDNSIDIVVEVMGGIEPTVDWLRTALKNKKHVITANKDLLAIHLKLLEDLAEENGVALKFEASVAGGIPIVNAINNGLNANNISKFMGIFNGTSNFILSKMTHEQTTFKDALEEAQRLGFAEADPTDDVEGVDAARKVVITSYLSFNQVIKLNDVKSVGISDITLADINAASALNYKIKSIGKGTYENGYVNASVEPTLIHKNHQLAAVENEYNAIYVIGDAVGDTMFYGKGAGSLATGSAVVSDLLNVALFFESNLHTLPPHFELKTEETKEMMDGAEPVVIQEKSNYYIVISNNNKSLEKVEYDIKKKLPFHKSLQLVERDQDTYAIIVTGIETSPEKVLNQSGFNIKKVYPVEGV

SEQ ID NO: 4147 - protein, 60 aa, Staphylococcus epidermidis
TEVYLMENNQSNITEETKHNDNLETTYEQTQQKEKTFSQEEVSQMIKDRLARKKRNLNNV

SEQ ID NO: 4148 - protein, 76 aa, Staphylococcus epidermidis
FNQYNERGMGFMQQIKFKTLTEETLESLEKSVNSFLKSQEGNGYKLLNITIKQIEERAFPHNDEDFNAILTLVTEA

SEQ ID NO: 4149 - protein, 418 aa, Staphylococcus epidermidis
KEMYNVTQHATYKTKNKRETAVLIGVHAQTDRQFNFESTMEELDALSQTCQLNVKGQITQNREQFDHKYYVGKGKIDEIKSFIEFHDIDVVVTNDELTTAQSKTLNDNLGIKIIDRTQLILEIFALRARSREGKLQVELAQLDYLLPRLHGHGKSLSRLGGGIGTRGPGETKLEMDRRHIRTRMNEIKHQLKTVVDHRERYRNKREQNQVFQIALVGYTNAGKSSWFNVLANEETYEKNILFATLDPKTRQIQVNEGFNLIISDTVGFIQKLPTTLVAAFKSTLEEAKGADVLMHVVDASHSEYRTQIDTVNQIINDLDMDHIPQVVIFNKKDLCNEQMDVPVSKSAHVFVSSRDENDKQKVKNLVIQEIKNSLSPYEEIVDSADADRLYFLKQHTLVTELIFDETQASYRIKGFKKL

SEQ ID NO: 4150 - protein, 235 aa, Staphylococcus epidermidis
ECSQEDYAMQQERQSWYQKSWFIILTLLFIFPLGLFLMWRYAHWKNWLKLTVSSVYIISLVLTLLFQVSLLNENKTNQIEHASTMKEKSNINNVKTTKNKNMEKSTQTDKQNSVNLKQNTKDQNNNANDEAASPTSEQNAAIAQAKSYANTLPISKKSLYKQLTSEYGEKYPADIAQYAVDHISVDYKMNALRLAKSYVKNINISNQALYDQLVSENGEGFTPEEAQYAMNHLDR

SEQ ID NO: 4151 - protein, 417 aa, Staphylococcus epidermidis
KGRQIMQDFSNLVEEVENTLIPYFRKIEKRALFNQEKVLNAFHHVKASESDLQGSTGYGYDDFGRDHLEQIYAHTFKADDALVRPQIISGTHAITLALQSTLKNNDELLYITGSPYDTLLEVIGINGNGVESLKEYGVRYNEVELRDGRIDIPKVITAINDNTKVVAIQRSKGYDQRPSITINEIEQAITSIKEVYPNIIIFVDNCYGEFVEDKEPIEVGADLIAGSLIKNPGGGLAKIGGYIAGRQDLIERCGYRLTAPGIGKEAGASLNSLQEMYQGFFLAPHVVSQSLKGALFTSLLLEKINMKTSPKYNVYRTDLIQTVQFETKEQMISFCQSIQHASPINAHFSPEPSYMPGYEDDVIMAAGTFIQGSSIELSADGPIRPPYEAYVQGGLTYEHVKLAVTRAVQHMQENNLL

SEQ ID NO: 4152 - protein, 177 aa, Staphylococcus epidermidis
TKTNYTNCVKLDVYRKGDKMESIYDFVVQKNNGESYKLEQYKGDVMLIVNTASECGFTPQFEGLQKLYDEYKDQGFIILGFPCNQFGGQEPGSGEEAAQNCKINYGVTFPIHEKVDVKGDNQHPLFHFLTNAAKGMINEKIKWNFTKFLIDREGNVIKRFSPQKKPEQIKTEIEKLL

SEQ ID NO: 4153 - protein, 134 aa, Staphylococcus epidermidis
INNKFKSRGEVQVMSNDSIRRNMAVFSMSVVSKLTDLSPRQIRYYETHELVMPERTDGNKRLFSMNDLERLLEIKSLIEKGFNIRGIKQIIFDEQGHLTTDEQETRKRMIVDATQKPRSETLPINRGDLSRFIK

SEQ ID NO: 4154 - protein, 149 aa, Staphylococcus epidermidis
VSRKKVHQFTENYDTLLIGIDMSRDTLYLRINKRVDIMLGHGLFNEVQHLVEQGFEASQSMQAIGYKELVPVIKGNISMENAVEKLKQHSRQYAKRQLTWFKNKMNVHWLNKERMSLQMMLDEITTQINKRSSNHDCKRKHPRPSTREL

SEQ ID NO: 4155 - protein, 364 aa, Staphylococcus epidermidis
LRANQHFSSNKLINIDLTLEGTLVISFENDYLEGAHEKVLNRLVETNRIQAAGYGFDDFSAQAADKIRQRIDCPDATIRFLVGGTQTNQVVINSMLDSYEGVISADTGHVAVHEGGAIEFSGHKVLTIPSQEGKITAQDVENYIETFESDFKKEHMVYPGMVYISHPTEYGTLYTKEELQSLSRVCRRHQIPLFMDGARLGYGLMSNQTNVTIEDVAKYCDVFYIGGTKIGALCGEAIVFTKQNEPKNFTTIIKHHGALLAKGRLTGVQFLELFTDDLYFDISRHAIKMAEKVKKGFIDKGYQVYFDSPTNQQFFILSNDKIEELKQKVKFAVWEKYDNQHRVVRFATSWATTEENVNQLLELI

SEQ ID NO: 4156 - protein, 318 aa, Staphylococcus epidermidis
QIKKGIGADVVSQSHFKITVEDGTMLEVKIDKAKKSTIGIVHLFHGMAEHMDRYQELVEALNTQGYDVVRHNHRGHGKEIDENERGHFNSMNQIVDDAYEIIETLYLEELNVPYIIIGHSMGSIIARSFVEKYPDIAQGLILTGTGMFPKWKGVPIRLAMKLVTFIFGKRRRLKWVNQLLNKTFNKKITQPRTDSDWISTRQDEVDKFVEDEFCGFKVSNQLIYQTLKTMMKTVERQQLKRMDKELPILFISGKDDPFGEYGKGIKHLARLYKRAGIKHITVQLYKHKRHEILFEEDYLKTWQHMFEWMEKQILKKQK

SEQ ID NO: 4157 - protein, 131 aa, Staphylococcus epidermidis
KEKNTRKSKKEIPDVIRSGKIKLDINPEKQNRHSLNHSLYLKNKNFALKNNERLPSYTTLSINELNRLVQQYSTSGKILINKNGFNHKKVINFERIIGKAFIDGKYIETTFGKVHYSKTDSHIIPFISKEK

SEQ ID NO: 4158 - protein, 69 aa, Staphylococcus epidermidis
VRRNKMLIKDAYRKNVIVTLKNNEKFKGFVFDYENPLESDTGNYSLDLETDLGIYSIDESEIKSIKLIS

SEQ ID NO: 4159 - protein, 235 aa, Staphylococcus epidermidis
NVLKKSCDEANKALKLYNLSMKVSREKLLKQQLDLIVKDSALDIHDEIENKLVDREVERQAHILGEHVKIDDTEVKAVVNSNFKGVNWSTRLCQDMAVVQKEVEKTTSNVLLRGRHPNEYVAKFKKQTNTTTYNASRLLVTESACVQAESQKLTYLKDLGEDGEYKYVAKIDKKTSKICHSLNGKVFKVKDMMPGVNAPPMHPWCRSTTVTHVGNWRDRFFTERKGKYQTENKES

SEQ ID NO: 4160 - protein, 463 aa, Staphylococcus epidermidis
KGRKIMKVAKFGGSSVSTAEQIKKVLTIVNEDPERKIIIVSAPGKRHNDDIKTTDLLIRLYEKVLNKLNYESKKQEIIQRYADIVEELGIGNDILITINDTLEEYIKHLSDKPNRLYDALLSCGENFNAQLIAQYNNSQGIPTRYISPKEAGLTVTDLPQQAQILDSAYNEIYKLRDYDEKLIIPGFFGVSKQNYIVTFPRGGSDITGAIIARGVRASLYENFTDVSGIYKANPNIINNPELIEEITYREMRELSYAGFGVFHDEALQPLYKDRIPVVIKNTNRPNDKGTYILHDREIDSKNVISGISCDKGFTVINIKKYLMNRLVGFTRKILGVLEEFNISFDHMPSGIDNISIIMRTNQIQGKESQVLNAIRKRCEVDELSIDHDLAVLMIVGEGMNQVVGTASKITHALSESNINLIMINQGASEISMMFGIHEADAEKAVLSTYEFCYNGVCLKNLCK

SEQ ID NO: 4161 - protein, 82 aa, Staphylococcus epidermidis
QRVEKEYSPSLMTSLFTESNPLTHKEQVVLREIGNGLSSKEIASKLYLSNGTVRNYTSTIIDKMNSDHRFEAWKKANEKGWI

SEQ ID NO: 4162 - protein, 211 aa, Staphylococcus epidermidis
FDCESACYRGGNMFVKEEKPVNKIVEILRKTSSHLFKFHGEVAMHLFLNDDFILPSKIDICVERKKLLEIIRVIPEEFTIHYYDNQLYERLRESLSLSDVEHVKVFKNDTEVMTIFVYDVVNDEWLFRLDHHIRLPKNNIYFHSLSWNVDYIKPEIVLMYDLMSEQKYHQFSNYKAVIDSLSYYQFYILKLVVGEQRIKKAIVNSSTKKIS

SEQ ID NO: 4163 - protein, 111 aa, Staphylococcus epidermidis
NGIEVDNMVGQTNLFDDVIKKEERFVIVVQALEEKNGKLLKRTLREYPSLEHTQMNDLFSHLKEVFLEEPFGVNQSAYSITVYTNLDYAADQVYAHVKRYKGKHDWTHTAK

SEQ ID NO: 4164 - protein, 128 aa, Staphylococcus epidermidis
RMKDAIQEAEKLAKMNKDQKNQYELEKLLKENEELKAEKALSQMKNETRSMLNESGLENFDDQIVNILVNTDAEKTRKNVESFTNLLNQMVKSNVEKALRQDSPVSTQSNKMTKDEESDYLVSGRKCL

SEQ ID NO: 4165 - protein, 239 aa, Staphylococcus epidermidis
RLDCYCIWLGFGSNNGRLCCWTFSGAHLNPAVTVALAMDGGFSWAQVPGYIVCQMLGGIVGGVFVWLMYLPHWKVTEDPAVKLGVFSTAPAIKNYFANFLSEIIGTMALTLGILFIGVNKIADGLNPIIVGSLIIAIGLSLGGTTGYAINPARDLAPRIAHAILPIHGKGKSNWSYAIVPVLGPMAGGMLGAIVYEVFYKQTFNFSCFIGLIVLIFTLILGVILNKISQNKNNDIESIY

SEQ ID NO: 4166 - protein, 370 aa, Staphylococcus epidermidis
ERRCTLMESRSWGVRIGELSTLIYLIFPILAIFVDKRGNFLTYLIVCTIFIISYVTMIIFYKYLSDSILYSLLVIHYLGIFYFVYSVNPMNSLFFFYSAFALPFIFNVRVVSKEFITFLIAMISCLILTYIFNPTFVVPLSAFYLVILIVAVGNFKNRDERIMKAKLEEKNKYINVLIAQQERNRISQDLHDTLGHVFASLTLKSELAVKLIDTNPKEAKNEMQAINQLSTEALNKVRLIIDDLKIQSFEDEISSLEHLLQNANLHFKFNNKSAAKSLNPAKQSILSMIFREAINNVIKHAHATEVIGELKVHEHQIILKIKDNGVGIENEDASNLKSIKERVDYLNGKLIVQSNNGTLIIVEIPRGDLL

SEQ ID NO: 4167 - protein, 299 aa, Staphylococcus epidermidis
HKSRGVTIMIELRHISKSFKEHKVLEDISIDIKNNCCTALIGKNGAGKSTLIDIIVGNNHYDSGQIADKSNLLNRHKMGILFQKTEFPKYIKVCELLHLYQSFYQTFISFHQFKEITQFSDRQMNQFACNLSGGQQRILDFALALVGKPELLILDEPTSAMDVEMRQHFWNVIDKLKMNNTTILYTSHYIEEVERMADQVMMLDKGKIQLDDSPENIKRNQSYSVIRIPCKYQELINQLKHKYEIELIKNRYEIKTTDVSDVLQLLKQYHVNFNKIEILKKSLLEVMFSNDLSKGGNYQ

SEQ ID NO: 4168 - protein, 367 aa, Staphylococcus epidermidis
YQESLSCRGSLIIMKRWQGLVKEFKEYLPVNQSTPALTLNEGHTPLIYCENLSQKLDIELYVKYEGANPTGSFKDRGMVMAVTKAKEQGKKVVICASTGNTSASAAAYAARAGLKAIVVIPEGKIALGKLSQAVMYGAEIVSIEGNFDEALEIVKEIAEENDEIELVNSVNPFRIEGQKTGAFEIVEQLDGQAPDILAIPVGNAGNITAYWQGFVEYHNKKNTQLPQMFGFQAEGASPIVQNKIIKNPETIATAIRIGNPASWQKAVNALDESNGLIDSVIDEEILEAYQLMTTNEGVFSEPASNASIAGLIKLHRSGKLPKGKKIVAILTGNGLKDPDTAISLLDNPIQPLPNNKESIIRYIKGAI

SEQ ID NO: 4169 - protein, 276 aa, Staphylococcus epidermidis
LLKGVLYYMTQYKMVVLDMDDTLMNSDNKLSIETKSYLLDIQKRGYYVVLASGRPTEGMLPTARELELNKYNSFIISYNGGKTINMANENVEVDQPVSKEDFDNIVDYCRDKNFLVLTYDNGYIIHDSSHEYMNIESQLTGLPMNRVADLKEYINHSVPKVMGVDYVGHITEARIELDGYFNNDIDVTTSKPFFLEFMAKNVSKGNAIKALCKRLQISLEEVIVFGDSLNDKSMFEVAGYSVAMGNASDELKKIADEVTLDNNSNGIPYALKELLV

SEQ ID NO: 4170 - protein, 504 aa, Staphylococcus epidermidis
RSHIPMEKYILSIDQGTTSSRAILFNKEGEIKGVSQREFKQHFPHPGWVEHDANEIWTSVLSVMAELLNENNINANQIEGIGITNQRETTVVWDKNTGRPIYHAIVWQSRQTQDICTNLKEQGYEETFREKTGLLLDPYFAGTKVKWILDHVEGAREKAENGDLLFGTIDSWLVWKLSGRTAHITDYTNASRTLMFNIYDLKWDDELLELLNIPKQMLPEVKESSEIYGKTIDYHFFGQEVPIAGIAGDQQAALFGQACFDRGDVKNTYGTGGFMLMNTGEEAVKSESGLLTTIAYGLDGKVNYALEGSIFVSGSAIQWLRDGLRMINSAPQTENYASRVESTEGVYMVPAFVGLGTPYWDSEARGAIFGLSRGTEKEHFIRATLESLCYQTRDVMEAMSKDSGIEVQNLRVDGGAVKNNFIMQFQADIVNSSVERPEIQETTALGAAYLAGLAVGFWDDKEDIRERWKLQTEFKPEMDADQRHKLYSGWKKAVKATQVFKLED

SEQ ID NO: 4171 - protein, 193 aa, Staphylococcus epidermidis
MTEMTKPFLIVIVGPTASGKTELSIEVAKKFNGEIISGDSMQVYQGMDIGTAKVTTEEMEGIPHYMIDILPPDASFSAYEFKKRAEKYIKDITRRGKVPIIAGGTGLYIQSLLYNYAFEDESISEDKMKQVKLKLKELEHLNNNKLHEYLASFDKESAKDIHPNNRKRVLRAIEYYLKTKKLLSFSQESAPIY

SEQ ID NO: 4172 - protein, 123 aa, Staphylococcus epidermidis
FIMISLVITEDQLMLRKAMVQLIEMHEEMNVIKDFENGVEALEFIENNEPNVAILDIEIPGLTGLEILSYVRKKQLNTRIIIVTTFKRPGYFEKAVANDVDAYVLKERSIDDLIKTIYKVTKG

SEQ ID NO: 4173 - protein, 452 aa, Staphylococcus epidermidis
NWRIYTMPKRSFTKDDIRKFAEEENVRYLRLQFTDILGTIKNVEVPVSQLEKVLDNEMMFDGSSIEGFVRIEESDMYLHPDLDTWVIFPWTAGQGKVARLICDVFKTDGTPFEGDPRANLKRVLRRMEDMGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPEGDLQLTDTAYQFTAGVLKNARGFTAVCNPIVNSYKRLVPGYEAPCYIAWSGKNRSPLVRVPTSRGLSTRIEVRSVDPAANPYMALAAILEAGLDGIENKLEVPEPVNQNIYEMNREEREAVGIQDLPSTLYTALKAMRENKSIKNALGNHIYNQFINSKSIEWDYYRTQVSEWEREQYIKQY

SEQ ID NO: 4174 - protein, 118 aa, Staphylococcus epidermidis
GLFVATGSVIFQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFFTLLFLIHIFFC

SEQ ID NO: 4175 - protein, 344 aa, Staphylococcus epidermidis
FIFFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 4176 - protein, 494 aa, Staphylococcus epidermidis
EYLVMNFGFLGTILTILLVVGFITNVVLAFVIIFLERDRRTASSTWAWLFVLFVLPVIGFILYLFLGRTVSKKKMEKNNGDELHAFEDLVQDQIDSFDKHNYGYINDQVIKHRDLIRMLLMKQDAFLTENNKIDLFTDGHKLYEKVLEDIYNAQDYIHLEYYTFELDGLGKRILDALETKLKEGLEVKLLYDDVGSKKVRLSKFKHFRALGGEVEAFFPSKVPLINFRMNNRNHRKIIIIDGQIGYVGGFNVGDDYLGLGKLGYWRDTHTRVQGECIDALQLRFILDWNSQSHRPQFKFDQKYFPKKNGDKGNAAIQIASSGPAFDLHQIEYGYTKMIMSAKKSIYLQSPYFIPDQSYINALKMAANSGVEVNLMIPCKPDHPFVYWATFSNAADLLDSGVNIYTYQNGFIHSKILMIDDEISSIGSANMDFRSFELNFEVNAFIYDEDIAKQLRQAFEKDIEQSKLLTKEVYDKRPLSIKFKEGLAKLISPIL

SEQ ID NO: 4177 - protein, 85 aa, Staphylococcus epidermidis
IKGVLTMIANENIQDQALENFKSEKTEVTIFFLNGFQMKGVVENYDKYVVSLNSQGKQHLIYKHAISTFTVDNESSEATEVNSEE

SEQ ID NO: 4178 - protein, 558 aa, Staphylococcus epidermidis
IMSLSTLKRDHIKKNLRDTEYDVVIVGGGITGAGIALDASNRGMKVALVEMQDFAQGTSSRSTKLVHGGLRYLKQLQVGVVAETGKERAIVYENGPHVTTPEWMLLPMHKGGTFGKFSTSIGLAMYDRLAGVKKSERKKMLSKQETLNKEPLVKRDGLKGGGYYVEYRTDDARLTIEVMKKAAENGAEIINYTKSEHFTYDSNKKVNGIEVLDMIDGETYAIKAKKVINASGPWVDEVRSGDYARNNKQLRLTKGVHVVIDQSKFPLGQAVYFDTEKDGRMIFAIPREGKAYVGTTDTFYDNEKATPLTTQEDRDYLINAINYMFPTVNVKDEDIESTWAGIRPLILEKGKDPSEISRKDEVWEGESGLLTIAGGKLTGYRHMALEIVDLLAKRLKQEYGLKFESCATKNLKISGGDVGGSKNFEHFVEQKVDAAKGFGIDEDVARRLASKYGSNVDQLFNIAQTAPYHDSKLPLEIYVELVYSIQQEMVYKPTDFLVRRSGKLYFNIQDVLDYKNAVIDVMADMLNYSETQKEAYTEEVEVAIDEARTGNDQPATKA

SEQ ID NO: 4179 - protein, 138 aa, Staphylococcus epidermidis
TKSSNACNSSPLFFSIFFLETVRPKNRYKINPMTGRTNNTNNHAQVELAVRRSRSRKMMTNANTTLVINPTTNNIVKIVPKNPKFITKYSYSVFHQENLAADLLNYASVTNVKIALKSSSLCGNARSSICLIVMFNNL

SEQ ID NO: 4180 - protein, 248 aa, Staphylococcus epidermidis
RRELPVISTYFKIELKIIFRKKLYLVMSIFLPVVFYLLFTSILDMPEEAKLKFYKEYMYSMTVFSLMNFCLLSFPLDLIEERNQGWYKRLMVTPLSSFQYYLVKISKTMCQFLIAITIIFSVAHFYKDVHMTVFQWIFSALTLWIGVSLFLTLGLIIAQLNDIQKASSFANLLNITLAILGGLWFPVYTFPDWLQSISKHMPTYNLKLLAIDLAQNKGVNIEAFGYLVVYCIIFVSIALFMNKKGDVH

SEQ ID NO: 4181 - protein, 169 aa, Staphylococcus epidermidis
SIISKSDINFYYCINKKIWRSDIMKTFKAVRFQIVNEHGAISEYVIEDGVIINKEGSGTGWLLEIVISNEHYETFKQYKDNKQLLDIRVVITRPANDPALFNATVKSVKNFKYSMSVVLECHIYTLRQEYAESLLEELVDEGLTGEKLKKTFNRMMQSKPKLKDEKIER

SEQ ID NO: 4182 - protein, 230 aa, Staphylococcus epidermidis
ENKSLLGGFLIMKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSTSQTSSSKASSGSSVNVNSHLQQIAQRESGGDIHAINPSSGAAGKYQFLQSTWDSVAPSQYKGVSPAKAPESVQDRAAVKLYNTGGPGHWVTA

SEQ ID NO: 4183 - protein, 141 aa, Staphylococcus epidermidis
GDFPPNSRDTFLKSFAAFSIIFEPVGPEPVNDIILTFGCSLKGFPTPDPSPLTKLNTPLGTPTLSKISAKIIAANGVSSDGFKTTGLPAANAAANLSEVWFVGKFQGVTSPATPIASLTTKSSPRCSSNWKLSKASLAAVK

SEQ ID NO: 4184 - protein, 99 aa, Staphylococcus epidermidis; identical to SEQ ID NO: 3070

SEQ ID NO: 4185 - protein, 237 aa, Staphylococcus epidermidis
FYFLRRLIMTFSKELREASRPIIDDIYNDGFIQDLLAGKLSNQAVRQYLRADASYLKEFTNIYAMLIPKMSSMEDVKFLVEQIEFMLEGEVEAHEVLADFINEPYEEIVKEKVWPPSGDHYIKHMYFNAFARENAAFTIAAMAPCPYVYAVIGKRAMEDPKLNKESVTSKWFQFYSTEMDELVDVFDQLMDRLTKHCSETEKKEIKENFLQSTIHERHFFNMAYINEKWEYGGNNNE

SEQ ID NO: 4186 - protein, 223 aa, Staphylococcus epidermidis
RRTFEMSILVIGANGGVGSKLVSQLNEEHVDFTAGVRKEDQVKELENKGIKATLIDVEKNSINDLKNIFTDYDKVIFSVGSGGSTGADKTIIVDLDGAVKTIKASKEAGIKHYVMVSTYDSRREAFDASGDLKPYTIAKHYADDYLRTSDLNYTIVHPGSLTDDAGTGKIEADLYFDKAGSIPREDVATVLKEVVTSDGFNNQEFQILSGNHGVKDALKNYES

SEQ ID NO: 4187 - protein, 404 aa, Staphylococcus epidermidis
YAKFQRELDTMHNKQKILDFIENNKYDYVEISHRIHERPELGNEEIFASRTLIDQLRANRFEIETDIAGHATGFIATYDSDMTGPVIGFLAEYDALPGLGHACGHNIIGTASVLAAVALKEVVDEIGGKVVVLGCPAEEGGENGSAKASYVKAGVIDEIDVALMIHPGNETYRTINTLAVDVLDIKFYGRSAHASENADEALNALDAMISYFNGIAQLRQHIKKGQRVHGVILDGGKAANIIPDFTHARFYTRATSRKELDVLTEKVNQIARGAAIQTGCDFEFGPIQNGVNEFIKAPKLDDLFEKYATELGEEVIDDDFGYGSTDTGNVSHVVPTIHPHIKIGSRNLVGHTHRFREAAASLQGDQALIRGAKILALMGLELIENKPLLDEIIEEHTHIKGHVK

SEQ ID NO: 4188 - protein, 397 aa, Staphylococcus epidermidis
MMTTPFKRIHLIVMDSVGIGEGPDAAAFNDEGSHTLKHTLEGFKQKLPHLEQLGLGNIAPLPVVSKVTHPGAFYTKLSEASVGKDTMTGHWEIMGLNIMQPFKVYPNGFPEELVKEIEDMTGRKVVANRPASGTQIIDEWGEHQMKTGDLIVYTSADPVLQIAAHEDVIPLEELYEICEKVRELTKDPKYLIGRIIARPYVGEPGNFTRTSNRHDYALKPFGRTVMNSLKDSGYDVIAIGKINDIYDGEGVTEAIRTKNNMDGMDQLIEVVKKDFEGISFLNLVDFDALYGHRRDKEGYAQAIKDFDLRLPELMNHLREDDLVIITADHGNDPIAKGTDHTREYIPLLMFSPKIKDYHELSQDTTFSSIGVTIADNFNVELPKYGKSYLKEMGVEHQ

SEQ ID NO: 4189 - protein, 303 aa, Staphylococcus epidermidis
IMWFCFLKSGFIIIKQILSTPFFSYKYNIKILINFKLISNIIEHKMLEYANKITLKGDNIMKFAVITDIHGNFDALQTVLDDIDSRDDIEKIYNLGDNIGIGHETNKVLDTIFDRDDMEMIAGNHDEAIMSLVNGTPYPEDLKGKFYEHHQWIEGHLDESYYDEINQLPRYIEMTIKGKKILFIHYEIENDKMSAPIDEQPFAPITKDDEQAISELFKDKEADLILFGHNHRLHMFDDKSTVYFNPGSVGLNNGSNTVYGIITVNEKGISVERVKLAYNNEEFLAGFEEKQVPAREFIFKNFI

SEQ ID NO: 4190 - protein, 342 aa, Staphylococcus epidermidis
MIYTFQLYLNKPFTTPNILVKVEFLMTNHNHQHHHSHAHGHVHTDNKKVLMFSFIIISLFMLVEIIGGFLANSLALLSDGFHMLSDAISLGVALIAFIYAEKHATKSKTYGYKRFEILAALFNGVTLFIISIIIIIEAIRRFLEPPEVQSKEMFIISVIGLMVNIIVAILMFKGGDTSHNLNMRGAFLHVLGDLFGSVGAIVASLLIWGFNFTIADPIASILVSLIILKSAYGISKSSLNILMEGTPNDIDLNAVIKAISKDERIQNVHDCHVWTISNDMNALSCHAVVPEYLSVQTCETMLKSIESDLLQLNIQHMTIQLETPEHKHDESTLCSGIHEHSH

SEQ ID NO: 4191 - protein, 561 aa, Staphylococcus epidermidis
IHRLLTVFNRFYQSLNSLLNFTGGQTMTKFIFVTGGVVSSLGKGITAASLGRLLKDRGLKVTIQKFDPYLNVDPGTMSPYQHGEVFVTDDGAETDLDLGHYERFIDINLNKYSNVTAGKVYSHVLKKERRGDYLGGTVQVIPHITNEIKERLLLAGESTNADVVITEIGGTTGDIESLPFLEAIRQIRSDLGRENVMYVHCTLLPYIKAAGEMKTKPTQHSVKELRGLGIQPDLIVVRTEYEMTQDLKDKIALFCDIKKESVIECRDADSLYEIPLQLSKQNMDDIVIQRLQLNAKYETQLDEWKHLLNTVNNLDGKITIGLVGKYVSLQDAYLSVVESLKHAGYPFKKDVVVKWIDSSEVNDDNVEAYLSDVDGILVPGGFGFRASEGKIAAIRYARENNIPFFGICLGMQLATVEFARHVLGYEGAHSAELDPSTPYPIIDLLPEQKDIEDLGGTLRLGLYPCHIKEGTLAEKIYNKNDIEERHRHRYEFNNEFREQLESNGMVFSGTSPDGRLVEIIEIPKNDFFIACQFHPEFLSRPNRPQPIFKSFVEAALNYQQK

SEQ ID NO: 4192 - protein, 97 aa, Staphylococcus epidermidis; identical to SEQ ID NO: 3072

SEQ ID NO: 4193 - protein, 261 aa, Staphylococcus epidermidis
SYCALYYKGSKNLIERGEFMDHKSPLVSWNVFGFDIVFNLASVLMVVITAILVFILAIVCTRNLKKRPTGKQNFIEWVFDFVRGIIESNMAWKKGGNFHFLAVTLILFIFVANMLGLPFAIVTHDHTLWWKSPTADATVTLTLSTTMILLTHYYGIKMRGTKAYAAGYFKPFWPLAIINVFEEFTSTLTLGLRLYGNIFAGELLLGLLASLFFEQPAWGWIISIPGLIVWQAFSIFVGTIQAYIFVMLSMVYMSHKVADGH

SEQ ID NO: 4194 - protein, 211 aa, Staphylococcus epidermidis
LSDYVLKKVELSMYETYHSGWIETITGSMFSGKSEELIRRLRRGIYAKQKVVVFKPAIDDRYHKEKVVSHNGNEIEAINISTAQEILNHMLEEVNVIGIDEVQFFEDDIVNIVEKLAENGHRVIVAGLDMDFRGEPFKPMPKLLAVSEHITKLQAVCSVCGSPSSRTQRLINGEPAKVDDPIILVGANESYEPRCRAHHIVAPSENEKEEM

SEQ ID NO: 4195 - protein, 190 aa, Staphylococcus epidermidis
QVCYVPFLFYTKGWVQMRDLQQLLDELKDMSFFNPGEMCIIGCSTSEVIGKRIGSVGSMDVAKEIYENLKQLEIDTGVTFAFQGCEHINRAVTIERANFNPLTMEEVTVVPDVHAGGSLSTYAYQQMEDPIVVEHITVSKGIDIGQTLIGMHIKHVCVPVRTSVKQIGEAIVTIATSRPKKIGGERAKYQ

SEQ ID NO: 4196 - protein, 68 aa, Staphylococcus epidermidis
SVRYSLNKFYYFVITIRIILPKEFNYLRLSILNSKSKFTATSKLAINSRFSRTLTNRTFYFSYFNFQH

SEQ ID NO: 4197 - protein, 124 aa, Staphylococcus epidermidis
TNIHMLECEFSMSGYHINVESNQDTLIKVTHIFKALSDFNRVRIMEFLENGEASVGHISHSLNMTQSNVSHQLKLLKSTHLVKSKRQGQSMIYSIDDIHVSTLLKQAIHHSKHPSEGGISNDKS

SEQ ID NO: 4198 - protein, 223 aa, Staphylococcus epidermidis
KSSQKGRDMNMMFDSKQLSVYFICGTQDIPKNKSIEQVLKEALEAGITLYQFREKGPNALKGEKKKQLALKLKQLCHSYHVPMIVNDDVQLAQEINADGIHVGQDDMEIQQFASQFKNKIIGLSVGNLKEYQQSDLSKVDYIGVGPMYTTSSKDDASKPVGPSMISQLRLYIHDFPIVAIGGINETNVQPIVDEGADGISVISAITRSTNIDKTVKYFLRYFT

SEQ ID NO: 4199 - protein, 228 aa, Staphylococcus epidermidis
TKKHGGKMMNKAKLIDHTLLKPDSTKEQIDTIINEAKAYQFKSVCVNPTHVQYASEQLKGTDVLVCTVIGFPLGATTTAVKSYETKDAINNGAQEIDMVINIGALKDGCFDEVQNDIEAVVQAANGKTVKVIIETVLLTEKEKIKACQLSEAAGAHFVKTSTGFAGGGATVEDVKLMKDTVGDRLEVKASGGVRNLEDFNNMIEAGATRIGASAGVQIIQGLESNTDY

SEQ ID NO: 4200 - protein, 467 aa, Staphylococcus epidermidis
INFKIRSIIMTEEINYFWLNCGYNRWNHNEPLVGQTALFESGAHFNPTQGYRAFKKAKAGDQVIFYQVQTDSGLLGIGEIISVQSGAQNKIRVEFKFKETLKPLTTDYLKRSETLDFRMSNMRETLFNQIRESEFELIVSLGKGKSKIPRYFLLAETEAFEPGKNYTIFTHTFNGIKRNGYHFYTQLEVGDNIIIYNKYQNQSVIGIGEVSKHIHEKPPIPGRTNSTAIEIFYEKDIKPISLGHLNKHPKLKNLYFLQENAKQSIASMSQAQYDAILDMSMNNGIKHPFETVKKAELSTQNAEDDSLKPFVLLVVEQKGEGLKAAEELLQKTNANPVITSGHPDFTEDMLYGKYLPNESGALYYREGFITHLMPKKDKSYLVIDNFNRIDVDIFQTYINVLEGYEVTLPRYNKDGSMIKWSKNKDSFYHFNPNWHIVGITYDSIEKIKQKYSSQFLKYTRIVKVNHD

SEQ ID NO: 4201 - protein, 384 aa, Staphylococcus epidermidis
NLFNYYKSGFQKAKPHNLKLILLSLITFVICYITSNIAFSLVILRAQRLPMLAQLGESTTKPIISIIFILLILALLFIFVGYPLITGTVYAIQKAINKEKVLFSDLFFAFKKGKYAKSVILALITLVLFIVIVLILVLLNKLYSLALSPILIGLQQSISGYDNPMGILITIQIVLLLITGFISSIFYWFVIIFIINYTTAYTEDSSRKVMSNLKEGFKGIKNGKKTWFKFFIGVLLISLLASIINKPLLFGVQYLTSSMSQTVAQTIIIIARIVSIVLRLCLYYILIFGIINYFVRRGDKPVKSKRRHKNKDINKGNVNDKVDTKLNASNSKDTEADKMKDQQTHIQQDKTDSQENNIYDSIKEKVNENKENVTEQSKNLFDKK

SEQ ID NO: 4202 - protein, 60 aa, Staphylococcus epidermidis
TIYKIFFIVVLYKKNVTFDQQHSTGGILIQLFENELNSALISLQHIITEEVKTCTHKYGI

SEQ ID NO: 4203 - protein, 166 aa, Staphylococcus epidermidis
NHYNIITIVKMRFEGVFDMSQQQDVVKELNQQVANWTVAYTKLHNFHWYVKGPNFFSLHTKFEELYNEASQYVDDLAERILAIGGNPIGTLSECLDKSIVNEAGKHYSAEEMVEELSKDFSKISKQLEQAIEVSGSASDDVSEDMFIGMQTSVDKHNWMLQSYLGH

SEQ ID NO: 4204 - protein, 320 aa, Staphylococcus epidermidis
AFNNGGVNMPLFLKPIFLDKVWGSDNLRQFGYQLPNNHIGECWGISAHPHGKSVIENGIFAGQTLDQVWNNHREIFGDFPSKDFPLMAKIVDAAAPLSIHVHPDDSYAYEHEEGQYGKSECWYIIEADEGAKITIGTYAKSRDEFEEQLEQGTFENYLRTIQVQPGDFYFIPAGTIHSIGAGIMAYEVMQSSDISYRIYDYHRKTDNSEERELNIDKALDVINYSNELPNITPQNEVIENHNCTHIVSSDFFTMVKWDISGTLNYMKPREFCLVSVLDGQGKLIVDGDIYEISKGSNFVLTSEDLDSVFEGDFKLIISYI

SEQ ID NO: 4205 - protein, 397 aa, Staphylococcus epidermidis
VMNNKVNGPFLTLSDLYNDDIVYTSRPSYVSNPWLKPDEHQSNFLTGRELLIANRFPVIVHEASVTNKLEQLFNIVGREIPPHTYKFKDQETYESLIRNLALHQGKKIYFQYIHNEDILPKEYYALDKDVFVALNNKARIPEWTNNKYLPQREIVSIKDFESRIQAWSYPFVIKPGDDLPTAGGYGVMICYNDTDLDKAITRINNASAETEHLIIEQKINAVNNYCVQFAYSDDIGIKYLGTAQQLTNDYGFYNGNENVNDVPQNVIDAGREIMEIGVSKGFFGVAGFDLLVDDNNDVYAIDLNFRQNGSTSMLLLAKDLTHGYHKFYSYFSNGDNTKFYNAILKYVELGVLYPLSYYDGDWYGKNQVNSRFGCIWHGENKELINQYEQQFILEAGL

SEQ ID NO: 4206 - protein, 263 aa, Staphylococcus epidermidis
MMNNLERLRSENPLVICYTNDVVKNFTANGLLSLGASPAMSEAPEEAEDFTRMASALLINIGTLTRENEEDIIKIGKIANQQGTPIVFDPVAVGASTYRKNFCQRFLGEVNVTVIKGNASEILTLIDFNTTMKGTDSDSELDSVNIAKKAANTLNTAIVITGKDDIIAKNEKIIKLSNGSPLLTKITGAGCLLGGVLASFLFRNTQPSIDLLVEAVSVYNIAAEFAEQAPHVNGPGTFLSELLDQLYQMNDITYKNQVKKVEI

SEQ ID NO: 4207 - protein, 289 aa, Staphylococcus epidermidis
MEDNMKNIKAIFLDMDGTILHENNKASEYTKQVINELREQNYKVFLATGRSYSEISQLVPDGFTVDGIISSNGTSGEIHGDNLFRHSLTLERVQKIVELAKKQHIYYEVFPFESNRISLKEDEDWMKEMISTIEPPDAVSQSEWSSRREAIKGKIDWRDTLPDAHFSKIYLFSPNLDKITDFRNQLVENQSNLGITVSNSSRYNAETMPYHTDKGTGIKEMIDHYGIKQEETLVIGDSDNDRAMFNFGHHTVAMKNARQEIKNLTDDITEYTNEEDGAAHYLKSHLLDN

SEQ ID NO: 4208 - protein, 74 aa, Staphylococcus epidermidis
ANILVVWATPHPFPLNIYFGTLAGGLGCFPFEHGPYHPCSDSQVKLIGIRSLSEFGNPRGALRPNSALPPIIIT

SEQ ID NO: 4209 - protein, 132 aa, Staphylococcus epidermidis
VRILPAEPWLLGQAVKTPPFHGGNTGSSPVGVILWRISSAGRASALQAEGRRFEPVILHHLIKYCGGVAKWLNAADCKSAPSGSAVRICPPPPFLGYSQAVRQRTLTPSCAGSNPASPAIRAISSVGRASDF

SEQ ID NO: 4210 - protein, 154 aa, Staphylococcus epidermidis
KFNKNLNRIDTIPQAILSFRLYEWNGLHDWYRTLGGYKMRRFNIIFKQYLQYYLYILVIIGILYSISPHPFLLGLMIGTCGSLVNTYIFEIYLAKSMHKETTQMSTGSTWRYLVAVIACVLWLFFKEHINIIGVLIGLMISYIVIILRPLLQRE

SEQ ID NO: 4211 - protein, 443 aa, Staphylococcus epidermidis
NGCKSMPGRERTSPQYESFHELYKNNTTKELTQKAKSLKLTNYSKLNKKELVLAIMEAQMEKDGNYYMEGILDDIQQDGYGFLRTVNYSKGEKDIYISASQIRRFEIKRGDKVTGKVRKPKDNEKYYGLLQVDFVNDHNAEEVKKRPHFQALTPLYPEERILLETQSTNYSTRIMDLVTPIGLGQRGLIVAPPKAGKTSLLKEIANAIASNKPEANLFILLVGERPEEVTDIERSVESAEVVHSTFDEPPEHHVKVAELLLERAKRLVEIGEDVIILMDSITRLARAYNLVIPPSGRTLSGGLDPASLHKPKAFFGAARNIEAGGSLTILATALVETGSRMDDMIYEEFKGTGNMELHLDRKLSERRIFPAIDIGRSSTRKEELLITKAELDSLWQLRNLFTDSTDSTDVLLENLSVRKVMKNCLSNCQKAVEESTKTGRPII

SEQ ID NO: 4212 - protein, 132 aa, Staphylococcus epidermidis
HMLNKIVIVGRMTKDAQIYEKEDNKIATFCVATERNYKDDNNEISTDYLLCKAFGKTATNIEKYTSQGTLVGITGQMRSRKYEKEGQTHFVTELYVETIKFMSPKNKNNETPSDNQFENNTYQPDDLEIIHI

SEQ ID NO: 4213 - protein, 237 aa, Staphylococcus epidermidis
MKLKREFTHSHLNIHYIINRHTHWRKMIMSKVHVFDHPLIQHKLSYIRDARTGTKEFRELVDEVGMLMAYEVTRDLELQDVEIQTPVTKMTAKRLAGKKLAIVPILRAGLGMTDGVLSLVPAARVGHIGLYRDPETLEAVEYFAKMPQDIDERQIIVVDPMLATGASAIEAISSLKKRGAKSIRFMCLIAAPEGVEKMQEAHPDVDIYIAALDEKLNDKAYITPGLGDAGDRLFGTK

SEQ ID NO: 4214 - protein, 503 aa, Staphylococcus epidermidis
MAIKAEEISALLRSQIENYESEMSVTDVGTVLQIGDGIALIHGLNDVMAGELVEFHNGVLGLAQNLEESNVGVVILGPYEEISEGDEVKRTGRIMEVPVGEEMIGRVVNPLGQPIDGQGPINATKTRPVEKKATGVMDRKSVDEPLQTGIKAIDALVPIGRGQRELIIGDRQTGKTTVAIDSILNQKDQDTICIYVAIGQKDSTVRANVEKLRQAGALDYTIVVSASAADPAPLLYIAPYSGVTMGEEFMFNGKHVLIVYDDLTKQAAAYRELSLLLRRPPGREAYPGDVFYLHSRLLERAAKLNDDLGGGSITALPIIETQAGDISAYVPTNVISITDGQIFLQSDLFFSGVRPAINAGQSVSRVGGSAQIKAMKKVAGTLRLDLASYRELESFAQFGSDLDEFTAKKLARGERTVEVLKQGQNNPLPVEHQVLIIFALTKGYLDDIPVQDINRFEEEFNHWAESNATELLNEIRETGALPDADKFDSAITEFKKGFNKSEE

SEQ ID NO: 4215 - protein, 180 aa, Staphylococcus epidermidis
IMAKVAKKYAKALFDVALDTNQLDVVYEDLETISHSSFDFIKQLKAIDSNPSLTANQREEFVERVYNEANPYVVNTLKVLADNRHISIVENVFKSFQNLYNKYYKQDFAIIESTYELSEDEISRIVELIKKQTELSNVIVNTKINQDLIGGFRVKVGTTVMDGSVRNDLVQLQRKFERAN

SEQ ID NO: 4216 - protein, 67 aa, Staphylococcus epidermidis
GNQKSYLVPFLYSKLNILMSIIILNFLLLNELEKSVMLDSIESNLKHCYFKGSFSENNGIVINKTLY

SEQ ID NO: 4217 - protein, 431 aa, Staphylococcus epidermidis
YFKKKETKEKSDMAQEVIKIRGGQALKGEVEISGAKNSAVAIIPATLLAQGQVKLEGLPQISDVETLVSLLEDLNIEARLNGKQLEVDTTQIENAPLPNNKVESLRASYYMMGAMLGRFKKCVIGLPGGCPLGPRPIDQHIKGFKALGAEIDESSNTSMKLVAKELRGAHIFLDMVSVGATINIMLAAVHAKGQTVIDNAAKEPEVVDVANFLMSMGADIRGAGTTSIKINGVEELKGSEYQIIPDRIEAGSYMCMAAAMGEEVILHNIVPKHVEALTVKLQELGVDIEIEDEKIIIRKQTPYKNVDIKTLVYPGFATDLQQPITPLLFMTEGPSFVTDTIYPARFKHVEELQRMGANIKSDEGTAVIKPSTLNGAEVYASDLRAGACLITAGLIAEGVTTIFNVKHIYRGYTNIVEHLKALGADIWTETV

SEQ ID NO: 4218 - protein, 144 aa, Staphylococcus epidermidis
AMKKECIHMPIIYYDGNCVYCYNYAIWLIQNGLSHKYEFATIKGQIGKQFFENYPDAQNKNSVILQKGNHLEFESQAVATLISSLPNHSKFLGIGLRLIPKPLRDLGYRLFANNRDKMWKTHWHKPTDYEKSFFLDDNEKIKLT

SEQ ID NO: 4219 - protein, 363 aa, Staphylococcus epidermidis
EGGNVVFDQLDIVEERYEQLNELLSDPDVVNDADKLRKYSKEQADLQKTVDVYRSYKTKKEELRDIEDMLNETSDKEEVEMLKEESSALKTELPDMEEELKILLIPKDPNDDKDVIVEIRAAAGGDEAAIFAGDLMRMYSKYAEANGFKTEIVEASESDHGGYKEVSFSVSGTGAYSKLKFENGAHRVQRVPETESGGRIHTSTATVAVLPEAEDVEIEIRNEDLKIDTYRSSGAGGQHVNTTDSAVRITHLPTGVIATSSEKSQIQNREKAMKVLKARLYDMKLQEEQQKYASQRKSAVGTGDRSERIRTYNYPQSRVTDHRIGLTLQKLNQIMEGNLDEIVEALTLSEQTEKLKELNNGEL

SEQ ID NO: 4220 - protein, 141 aa, Staphylococcus epidermidis
KAMKIIFVCSGNTCRSPLAESIAKSLLPHDSIASRGLFAVEGQAISKESLELIHKYDLPEPSRAQAFHIDDLDADIILTMTQAHKDLIFSMYGRQSNVFTLNEYVGDTQEIDDPFGGSFDVYEQTYTKIYDLVDKIKFKHE

SEQ ID NO: 4221 - protein, 118 aa, Staphylococcus epidermidis
ASMKVLRFLLGLAFGTAGVLHFTRERQFRNIVPDYLPLQKTAVLVTGVIEIFFGIMLLIKRPASWLKKGINLFLLAVFPANIYMARKGLPLGDKELPKWALYSRLPLQFVLIKAIKKL

SEQ ID NO: 4222 - protein, 279 aa, Staphylococcus epidermidis
TMVNYKEKFAEAKTIAVNEGFESTRAEWLFLDVFGWSKTDYLIHKDEQMSLTSINKLDKALDRMITGEPIQYIVGFQSFYGYQYKVNQHCLIPRPETEEVMLHFLELCKKTDTIADIGTGSGAIAITLKLLQPELNVIATDLYEDALNVAKQNASHYHQNIQFLRGNALKPLIENDIKLDGLISNPPYIGHSEIIDMESTVLNYEPHHALFAEKNGFAIYESILEDLPFVMKQGGHVVFEIGYSQGDILKRMIQDLYPEKEVEIFKDINGNQRIISIIW

SEQ ID NO: 4223 - protein, 116 aa, Staphylococcus epidermidis
LSNLFLNFKMLKSNIHFYKYLYCLFSCTMLYSNLTKELNMDYLGQFAIVHLILHVVCICVAYWALNSIKLDQFFKKGYPLQVQVCMIFISILLGTAVSNFIVDLLQYSTQVKYLIK

SEQ ID NO: 4224 - protein, 67 aa, Staphylococcus epidermidis
PLIDCCKPINIGLRAKLYNLFNSTRISTITMNKTKVIKAKITDLAYLPFLKAKNKSLKRTFSLLIAF

SEQ ID NO: 4225 - protein, 163 aa, Staphylococcus epidermidis
SNKEDKCMTKMNVESFNLDHTKVVAPFIRLAGTMEGLNGDVIHKYDIRFKQPNKEHMDMPGLHSLEHLMAENIRNHTDKVVDLSPMGCQTGFYVSFINHDDYDDVLNIIDQTLHDVLNASEVPACNEVQCGWAASHSLEGAKTIAQAFLDKREQWNDIYGEGK

SEQ ID NO: 4226 - protein, 458 aa, Staphylococcus epidermidis
IQKERLKMGKYFGTDGVRGVANQELTPELAFKLGRYGGYVLAHNKGEKHPRVLVGRDTRVSGEMLESALIAGLISIGAEVMRLGVISTPGVAYLTKEMEAALGVMISASHNPVADNGIKFFGSDGFKLSDDQENEIEQLLDQTNPDLPRPVGEDIVHYSDYFEGAQKYLSYLKSTVDVNFEGLKIVLDGANGSTSSLAPFLFGDLEADTETIGCNPDGYNINEQCGSTHPEKLAEAVLETESDFGLAFDGDGDRIIAVDENGQIVDGDQIMFIIGQEMYKNQELNGNMIVSTVMSNLGFYKALEKEGIQSNKTKVGDRYVVEEMRRGNYNLGGEQSGHIVLMDYNTTGDGLLTGVQLASVIKMSGKTLSELASQMKKYPQSLINVRVTDKYRVEENIHVQEIMTKVETEMNGEGRILVRPSGTEPLVRVMVEAATDADAERYAQSIADVVEDKMGLDK

SEQ ID NO: 4227 - protein, 365 aa, Staphylococcus epidermidis
IKFCPYFFTAYNHRRGENMHTQIWDLRMYKNNVSQYPHIDEIKQTFLDGGLVAIPTETVYGLGANARNEEAVENIYVAKGRPSDNPLIVHIHSIEQLDDFVEYIDDKVKVLMDEFWPGPISFILPLKQGYLCSKVTGGLESIAVRMPSHKIGRALLQIVDEPIAAPSANISGRPSPTTFEHVNRDLNGKVNGIVNGDQCEEGLESTVIDCTQFPFRIARPGSITQDMIETKLPHSINRQIYEENEKPIAPGMKYKHYSPETPLTIVKDLNKKIANDDKWSKVAFVFPESQRSLIPENSIFISLCENKGDFKSAGHNLYEILHELDQNEEIEEAYIYGFEDNHHTEAIMNRMLKAASYKLIKGEKL

SEQ ID NO: 4228 - protein, 62 aa, Staphylococcus epidermidis
TYNWNGFYIKRQLFKTFGKHILNDSQLSVILVTHIIEEMPLFLKKIYLKTFKYLTRLIFKML

SEQ ID NO: 4229 - protein, 178 aa, Staphylococcus epidermidis
RKECHEPVTATANTFILGAGVEWGTTFVTLVTFVILIILLKKFAWGPLKEVMDKRERDINKDIDDAEQAKINAQKLEEENRKTLKETQDEVQKILDDAKIQARKQHEEIIHEANEKANGMIETAQSEINSQKERAISDINNQVSELSVLIASKVLRKEISEQDQKELVEKYLKEAGDK

SEQ ID NO: 4230 - protein, 296 aa, Staphylococcus epidermidis
NVILSYDSVNNDWYNNQYGKVLPGGDVMDFSNFFQNLSTIKIITSLLDLLIVWYVLYLLITVFKGTKAIQLLKGIVVIVIGQQISKILNLTATSKLFDIVIQWGVLALIVIFQPEIRRALEQLGRGSFLKRYTNTYSRDEEKLIQSVSKAVQYMAKRRIGALIVFEKETGLQDYIETGIPMNSDISQELLTNVFIPNTPLHDGAMIIQGSKIAVAASYLPLSDSVKISKSLGTRHRAAVGISEVSDAFTVVVSEETGDISVTFDGKLRRDISKDVFEELLAEHWFGAHFQKKGVNS

SEQ ID NO: 4231 - protein, 293 aa, Staphylococcus epidermidis
LIDRGKAMFIKKDFDDITVQVFEEKYRDALNQFELSERQQIYSSLPQTVLDDALKDENRIANVALNKEGKVVGFFVLHRYYQHEGYDTPNNVVYVRSLSVNEKFQGHGYGTKMMMFLPEYVQALFPDFTHLYLVVDAENQSAWNVYERAGFMHTATKEEGPIGKERLYYLDLDSKHVSSLRLKEGEAAYNDDIHVINLLKDDVKVGFIALEQNDNKMNISAIEVNKQNRNEGIAESALRQLPTYIRKQFEDIEILSITLYGERNELKPLCLNSNFVAIEETEDYTRFEKYINY

SEQ ID NO: 4232 - protein, 68 aa, Staphylococcus epidermidis; identical to SEQ ID NO: 3076

SEQ ID NO: 4233 - protein, 98 aa, Staphylococcus epidermidis
LCSRWFRAKELKKMKQGIHPEYHKVIFLDTTTNFKFLSGSTKTSSETMEWEDGNEYPVIRLDVSSDSHPFYTGRQKFAAADGRVERFNKKFGLKSNNN

SEQ ID NO: 4234 - protein, 156 aa, Staphylococcus epidermidis
YYYSLSSEVLKMETIFDYNQIKQIIPHRQPFLLIDKIVEYEEGKRCVGLKQVSGNEPFFQGHFPNYAVMPGVLITEALAQTGAVAMLNSEENKGKIALFAGIDKCRFKKQVVPGDTLMLEVEITKIKGPIGKGSAKATVDGQLACSCELTFAIQDA

SEQ ID NO: 4235 - protein, 311 aa, Staphylococcus epidermidis
MLESKWGLRFVALILAVFFFLSVNNVFGNIFNTDDLSQKSSKTIQDVPVDVIYNSKDLHVTKIPENVDVNLTGPQSKLIKIENPEDLKVVVDLSGKKAGKYQKKYQVRGIDSGINYQIKPEVAHINLENKITRVMHVQPDISSNSLDPKYKISKQSISPETVKVTGGEQQLKNIAYLKATFKNSSKVNKDTNDVADVSAFDKQLNKLNVSINPNEVNLKVTVEPFSKMVKVRKKTTGKLNENKELDSVKLEDKEVEIFGNRDELQNINEITAEVDIDGISESTEKTVSFNLPKDVTKVNPKETKAYINVKN

SEQ ID NO: 4236 - protein, 81 aa, Staphylococcus epidermidis
YKERGFVKQFIYISLVCGIISGAGIFLQLPHYPSMMIPRFVAILGIISAAITIRDKEISGMLKLGGIMINIMPLLGSVIAK

SEQ ID NO: 4237 - protein, 179 aa, Staphylococcus epidermidis
RDWRFTMSKILNTQLTGIFNRLEKQELDIQMAAQCLIQAIGGEGHVYIKGYDDLKFYESFILQSHEKLASSLPLEDLQNFNDIDTTDRVLLFSPYYTSEVESDVLQLIDLDVDLVLICNNPKRDDFPNHLIHYVNLSTPRPIVYTEDYDKIIQPHPMALNYIYYDIYTQMIEMTRDLDL

SEQ ID NO: 4238 - protein, 272 aa, Staphylococcus epidermidis
LLWSDRHMKIGIDAGGTLIKIVQEHDNRRYYRTELTTNIQKVIDWLNNEEIETLKLTGGNAGVIADQIHHSPEIFVEFDASSKGLEILLDEQGHQIEHYIFANVGTGTSFHYFDGKDQQRVGGVGTGGGMIQGLGYLLSNITDYKELTNLAQNGDRDAIDLKVKHIYKDTEPPIPGDLTAANFGNVLHHLDNQFTSANKLASAIGVVGEVITTMAITLAREYKTNHVVYIGSSFNNNQLLREVVENYTVLRGFKPYYIENGAFSGALGALYL

SEQ ID NO: 4239 - protein, 243 aa, Staphylococcus epidermidis
LLRRRYIMTESTPHINPNGVKIAKTVLMPGDPLRAQYIAENFLENVEQFNTVRNMFGYTGTYKGKEVSVMGSGMGIPSIGIYSYELYHFFDVDTIIRVGSCGALQEDVNLYDVIIAQAASTNSNYVDQFNIPGHFAPIADFNLVAKAKKAADEIGAISHVGNVLSSDTFYNADSTFNDSWKKMGILGIEMESAGLYLNAIHANKKALGIFTVSDHILRDEATSAEERQTSFTQMMEIALEIAE

SEQ ID NO: 4240 - protein, 75 aa, Staphylococcus epidermidis
PKNGGGGQIRTAEPEGADLQSAAFSHFATPPQYLIKWWRMTGSNRRPSACKADALPAELILHKMTPTGLEPVLPP

SEQ ID NO: 4241 - protein, 229 aa, Staphylococcus epidermidis
ATPGVEITPKRITSAPIEIKPAINADSSISPDTLVSLPTKTRGCFSPLLCARTYPPYLPSLKANSGVSSWLATPRTPSVPKYFPIFKRSFCIYQFLTFIYAFVSFGFTLVTSLGKLNDTVFSVDSEIPSISTSAVISLIFCNSSLLPKISTSLSSSLTLSNSLFSLSLPVVFLRTLTILLNGSTVTFKLTSFGLIDTFNLFNCLSNALTSATSLVSLFTLLEFLKVAFK

SEQ ID NO: 4242 - protein, 295 aa, Staphylococcus epidermidis
YSKGGEIMASLKEIDSRIKSTSKMKQITKAMNMVSSSKLRRAEKNTKSFRPYMEKMQDAITAVAGSNSTSNHPMLKSRDIKRSGYLVITSDKGLAGAYSTNVLKSLVNDINSKHNDSSEYSLIVLGQQGVDFFKHRGYEIESSLVEVPDQPSFKSIQSIAKHAIDLFSEENIDELTIYYSHYVSVLENKPATKQVLPLSQEDSGQGHGQMSSYEFEPDKESILSVILPQYVESLIYGTILDAKASEHASRMTAMRNASDNATELIDDLSLEYNRARQAAITQQITEIVGGSSALE

SEQ ID NO: 4243 - protein, 77 aa, Staphylococcus epidermidis
ILGGNFIMNLIAAAIAIGLSALGAGIGNGLIVSRTVEGVARQPEARGQLMGIMFIGVGLVEALPIIGVVIAFMTFAG

SEQ ID NO: 4244 - protein, 412 aa, Staphylococcus epidermidis
MSYIEKKDKVVYDAIQKEFQRQNSNIELIASENFVSQAVMEAQGSVLTNKYAEGYPGRRYYGGCEHVDVTESIAIERAKALFGAEHVNVQPHSGSQANMAVYLVALEMGDTVLGMNLSHGGHLTHGATVNFSGKFYHFVEYGVDQENELINYDEVRRLAIEHQPKLIVAGASAYSRTIDFKKFKEIADEVGAKLMVDMAHIAGLVAAGLHPNPLEYADFVTTTTHKTLRGPRGGMILCKEEYKKDIDKTIFPGIQGGPLEHVIAAKAVAFGEALNDDFKDYQNQVIKNAQALAQTLIEEGFRVVSGGTDNHLVAVDVKGSINMTGKLAEETLDKVGITCNKNTIPFDKEKPFVTSGVRLGTPAATTRGFDESAFVEVAKIISLALNNYDNDTKLNEAKERVHALTSKYPLYN

SEQ ID NO: 4245 - protein, 71 aa, Staphylococcus epidermidis
KLILKIKNASIIVRHLHIIIFYLAMTLPSNGIILIIIPPSLSIPLISLSLIVIAALIIPRIATNLGIIIDG

SEQ ID NO: 4246 - protein, 488 aa, Staphylococcus epidermidis
YMYISFLRSEYNKMRNFTKQYINGEWVDSASGETIDVINPATEEVMGKIAKGNEEDVNKAVDAADKVYLEFRHSSVEERRELLDKIVKEYQNRKNDLIEAITDELGAPLSVSENVHYQMGLNHFTAARDALDSFQFEEQRGDDLVVKEAIGVAGLVTPWNFPTNQTSLKLAAAFAAGSPVVLKPSEETPFAAIILAEIFDKVGVPKGVFNLVNGDGSGVGNPLSEHPKVRMMSFTGSGPTGSKIMEKAAKDFKKVSLELGGKSPYIVLDDVDVEEAANATTKKVVNNTGQVCTAGTRVLIPESIKEDYLTAVKEAFSKVKVGQPREEGTQVGPIISKKQFDQVQDYIDKGINEGAELFYGGPGKPEGLDKGYFARPTIFINVDNHMTIAQEEIFGPVMSVITYNNLDEAIEIANDTKYGLAGYVIGKDKDTLRHVARSIEAGTIEINEAGRKPDLPFGGYKESGLGREWGDYGIEEFLEVKSIAGYFK

SEQ ID NO: 4247 - protein, 224 aa, Staphylococcus epidermidis
GLSMSYKYEAFFKDILINEYIYFASKNKKLIRIQHENLPYIAMWTDENVAESYLLHHSIDYDKIIRADIDRFVTYEMDEIFDPGDKVLVNVNNGEEGNIVDIVKMTDELMSELDDIRMREFIKDVAKYDEVYGLTNKGEKNFIMISDDDHNKPHIMPVWSIKSRARKVRDQDFEECDLIEIEGEVFSEWLDKLRDDNKAVAIDLKSGVVGTVVSAQKLSNEATF

SEQ ID NO: 4248 - protein, 619 aa, Staphylococcus epidermidis
AVIINHNSRVIPFVGGYYMCGIVGYIGYDNAKELLLKGLEKLEYRGYDSAGIAVVNDDGTKLFKEKGRIAELRKVADNSDEDGTLGIGHTRWATHGVPNYENSHPHQSTSGRFTLVHNGVIENYEELKAEYLSDVTFSSETDTEVIVQLVDYFSRQGLATEDAFTKVVKLLHGSYALGLLDDNDKDTIYVAKNKSPLLVGVGEGFNVIASDALAMLQTTNQYKEIHDHEIVIVKRDTVEIKDLEGHIQQRDTYTAEIDAADAEKGVYDHYMLKEIHEQPAVMRRIIQEYQDEKGNLKIDSEIINDVADADRIYIVAAGTSYHAGLVGKEFIEKWAGVPTEVHVASEFVYNMPLLSEKPLFIYISQSGETADSRAVLVETNKLGHKSLTITNVAGSTLSREADHTLLLHAGPEIAVASTKAYTAQIAVLSILSQIVAKNHGRETDVDLLRELAKVTTAIETIVDDAPKMEQIATDFLKTTRNAFFIGRTIDYNVSLEGALKLKEISYIQAEGFAGGELKHGTIALIEDGTPVIGLATQENVNLSIRGNMKEVVARGAYPCMISMEGLNKEGDTYVIPQVHELLTPLVSVVTMQLISYYAALQRDLDVDKPRNLAKSVTVE

SEQ ID NO: 4249 - protein, 188 aa, Staphylococcus epidermidis
RKSFERKYFYMKIQDYTKEMVDEKSFIDMAYTLLNDKQTTMNLYDIIDEFKSLGGYEYEDIENRIVQFYTDLNTDGRFLNVGENLWGLRDWYSVDDIEEKIAPTIQKFDILDDEDEEDQNLKLLGDDDADEDDDIPAQTDDQETLDESDNDEDDVEMNEADIVIDEDEDEDIAEGEEEAFEDAEDFND

SEQ ID NO: 4250 - protein, 475 aa, Staphylococcus epidermidis
KEEINMGIGRVAQVMGPVIDVRFEHNEVPEINNALHIEVPKEDGALQLTLEVALQLGDDVVRTIAMDSTDGVQRGMEVKDTGRDISVPVGDVTLGRVFNVLGETIDLDEKIDDSVRRDPIHRQAPGFDELSTKVEILETGIKVVDLLAPYIKGGKIGLFGGAGVGKTVLIQELINNIAQEHGGISVFAGVGERTREGNDLYYEMSDSGVIKKTAMVFGQMNEPPGARMRVALSGLTMAEYFRDEEGQDVLLFIDNIFRFTQAGSEVSALLGRMPSAVGYQPTLATEMGQLQERISSTNKGSVTSIQAVFVPADDYTDPAPATTFAHLDSTTNLERKLTEMGIYPAVDPLASTSRALEPSVVGQEHYDVAREVQSTLQKYRELQDIIAILGMDELSDEDKQTVERARRIQFFLSQNFHVAEQFTGQKGSYVPVKTTVADFRDILDGKYDHIPEDAFRLVGSMEDVIEKAKDMGVEV

SEQ ID NO: 4251 - protein, 434 aa, Staphylococcus epidermidis
IMRMIDIIEKKRDGKSLTKEEIEFFVNGYTHEEVPDYQASSLAMAIFFQDMNDEERAALTMSMVNSGEKIDLSDINGIKVDKHSTGGVGDTTTLVLAPLVAAVGVPVAKMSGRGLGHTGGTIDKLESVKGFNVEISEKDFIKLVNDNQVAVIGQSGNLTPADKKLYALRDVTGTVNSIPLIASSIMSKKIAAGADAIVLDVKTGSGAFMKTLDDAEALAHAMVRIGNNVGRNTMAIISDMSQPLGNAIGNALELKEAIATLKGNGPKDLTELVLTLGSQMVVLAEQATSLDEARQMLIDAIKTGKALNKFKTFLSNQGGDDSIVDSPEKLPSAKYQVEFKAKKDGYITEIIANEIGVASMMLGAGRQTKEDVIDLGVGIVLNKKVGEHVEKGENILTIHTNTKEIDDILYKLDNSITIESKGEAPTLIHKIITE

SEQ ID NO: 4252 - protein, 353 aa, Staphylococcus epidermidis
IFLMKKVMTIFGTRPEAIKMAPLIKTLEKDSDLEPVVVVTAQHREMLDSVLNTFNISADYDLNIMKAGQTLSEVTSEAMKKLEDIIQKEVPDMVLVHGDTVTTFSGALAAFYSQTPIGHVEAGLRSYNKYSPYPEEINRQMVGVMADLHFAPTYNAAQNLVKEGKLAKHIAITGNTAIDAMNYTIDHQYSSSIIQKHKNKNFILLTAHRRENIGKPMINVFKAIRKLIDEYQDLALVYPMHMNPKVRDIAQKYLGNHPRIELIEPLDVVDFHNFAKQAYLIMTDSGGIQEEAPSLHKPVLVLRDSTERPEGVDAGTLRVIGTNEEDVYNETKKLIENPDLYQKMSQAVNPYGG

SEQ ID NO: 4253 - protein, 69 aa, Staphylococcus epidermidis
ISVITANFMILSPFNVILLAYSNILCSIMLDINLKFIRILILYLYEKKGVLKICLIIINPDFKKQNHII

SEQ ID NO: 4254 - protein, 138 aa, Staphylococcus epidermidis
EVWIMNTLRLNIVTPNGSVYEREDVEMAVLQTTAGEMGIMYGHIPTVAALKTGHVKVNFHNGNEFIAVSDGFIEARQHQLSIIVQTAEPASEIDVERAKLAKSRAESHLEDDDDNTDINRAKRALERANNRLRVAELQ

SEQ ID NO: 4255 - protein, 315 aa, Staphylococcus epidermidis
LNIVVRQKKKRLKKISCKVLFMRDISSIWHILMKNGNMGEITMNKPKIALTIAGTDPTGGAGVMADLKSFHACGVYGMATITSIVAQNTLGVQHIHNLESSWVKEQLDSVFDDELPQAIKTGMIATKKTMELIQSYLKEHSNIPYVIDPVMLAKSGDSLMDENTKNHLQSTLLPLADVVTPNIPEAEEITGIKINDEESIRKAGQIFINEIGSKGVVIKGGHSADLNNAKDFLFTKNETYTFENKRFDTKHTHGTGCTFSAVITAELAKGRSIKDAVKKAKEFISLSIEHTPEIGKGRGPVNHFAYMKKVGLDDE

SEQ ID NO: 4256 - protein, 303 aa, Staphylococcus epidermidis
YNDVEKNVHCCTQGGTLMPLVSMKEMLIDAKENGYAVGQYNLNNLEFTQAILEASQEENAPVILGVSEGAARYMSGFYTVVKMVEGLMHDLDITIPVAIHLDHGSSFEKCKEAIDAGFTSVMIDASHSPFEENVEITSKVVEYAHDRGVSVEAELGTVGGQEDDVVADGVIYADPKECQELVEKTGIDTLAPALGSVHGPYKGEPKLGFKEMEEIGASTGLPLVLHGGTGIPTKDIQKAIPYGTAKINVNTENQIASAKAVREVLNNDKDVYDPRKYLGPAREAIKETVKGKIREFGTSNRAK

SEQ ID NO: 4257 - protein, 431 aa, Staphylococcus epidermidis
LIRVLSGGLKMDKIVINGGNRLTGEVNVEGAKNAVLPVLTASLLASEGHSKLVNVPELSDVETINNVLSTLNANVEYDKDKNAVKVDATKTLNEEAPYEYVSKMRASILVMGPLLARLGHAIVALPGGCAIGTRPIEQHIKGFEALGADIHLENGNIYANAKDGLKGAHIHLDFPSVGATQNIIMAASLASGKSIIENVAKEPEIVDLANYINEMGGKITGAGTDTITIHGVEKLYGVEHAIIPDRIEAGTLLIAGAITRGDIFVRGAIKEHMASLIYKLEEMGVDLEYYEEGIRVTANGDLNPVDVKTLPHPGFPTDMQSQMMALLLTANGHKVITETVFENRFMHVAEFRRMNANISVEGRSAKIEGKSHLQGAQVKATDLRAAAALILAGLVAEGTTQVTELKHLDRGYVNLHGKLKSLGANIERVNR

SEQ ID NO: 4258 - protein, 61 aa, Staphylococcus epidermidis
REELDTVIPKFDWFSTSWLRKSVILSKLGLNKYILEKCASGKVSRQSIFPLIASLRDDHSL

SEQ ID NO: 4259 - protein, 376 aa, Staphylococcus epidermidis
TITLKKKAKRTVIVMEENEMTKENICIVFGGKSAEHDVSILTAQNVLNAIDKERYQVDIIYITNDGEWKKKDNITQEIKNTDELVINDVETGEISQLLSKGSLGKSYDAVFPLLHGPNGEDGTIQGLFEVLDIPYVGNGVLAASSSMDKLVMKQLFEHRGLPQLPYISFLRSEYEKYENNIIKLVNDKLTYPVFVKPANLGSSVGISKCNNEEELKSGIAEAFQFDRKLVIEQGINAREIEVAVLGNDYPETTWPGEVVKDVAFYDYKSKYKDGKIRLDIPADLDQDVQMTLRYMALEAFKATDCSGLVRADFFVTDDNQIYINETNAMPGFTAYSMYPNLWKNMGLSYPDLIAKLIDLAKERYEDKKKNKYKIDY

SEQ ID NO: 4260 - protein, 156 aa, Staphylococcus epidermidis
LWLTQMNNLALQSLTESIAIKYFGKAFKHEVYYNKRLRTTGGRYILSSHNIEINPKQYEMFGEKAVIDIIKHELCHYFLHLAGEGYQHRDKAFKILSAKVGAPRFCTPTESYQDRANYKYRCIYCEQEFIRIKRVNLEKMRCGRCGGILKLIQTRK

SEQ ID NO: 4261 - protein, 404 aa, Staphylococcus epidermidis
AMNYSSRQQPKRNWLRKVDWILVLVISLLALTSVILISSAMGGGQYSANFSIRQIIYYIFGAIIAFLIMIISPKKIKNNTYILYSIFCVLLIGLLILPETSITPIINGAKSWYSFGPISIQPSEFMKIILILALAKTISKHNQFTFNKSFQSDLMLFFKILGVSIIPMALILLQNDLGTTLVLCAIIAGVMLVSGITWRILAPLFIVAFVSGSSIILAIIYKPSLIENLLGIKMYQMGRINSWLDPYSYSSGDGYHLTESLKAIGSGQLLGKGYNHGEVYIPENHTDFIFSVIGEEMGFIGSVLLILLFLFLIFHLIRLASKIDSQFNKVFIIGYVSLIVFHVLQNIGMTVQLLPITGIPLPFISYGGSSLWSLMTGIGVVLSIYYHEPQRYEIPTLSKKSNTI

SEQ ID NO: 4262 - protein, 528 aa, Staphylococcus epidermidis
VNIYVKKHIKKYTRKRRIILQNFKELGISDKTVQTLEAMGFKEPTPIQKDSIPYALEGDDILGQAQTGTGKTGAFGIPLIEKVVGQQGVQSLILAPTRELAMQVAEQLREFSKGQKVQVVTVFGGMPIERQIKALKRGPQIVVGTPGRVIDHLNRRTLKTQGIHTLILDEADEMMNMGFIDDMRFIMDKIPAEQRQTMLFSATMPKAIQELVQQFMKAPKIIKTMNNEMSDPQIDEYYTIVKELEKFDTFTNFLDVHQPELAIVFGRTKRRVDELTSALLSKGYKAEGLHGDITQAKRLEVLKKFKNDQIDILVATDVAARGLDISGVSHVYNFDIPQDTESYTHRIGRTGRAGKEGIAVTFVNPIEMDYIRQIEDVNNRRMKALRPPHRKEVLKAREDDIKDRVQNWMSRENEPRLQRISSELLKEYDSTELVASLLQELVEANDEVEVQLTFEKPLARKNRSNKGGSRRSNHKRGNGKFDNKNRRSKGSKGQSSKKKNQKKFDRRDKQQKSGNQSLKGRTFADHQK

SEQ ID NO: 4263 - protein, 108 aa, Staphylococcus epidermidis
IIRYNMNRGDFMADMESAHHSEQIKTNLKSRLNRIEGQVRAINRMIDDDVYCDDVLTQIRATRSALNSVATKLLDHHMKGCIMEKINDGAQEEAMDELLVTFQKLIKD

SEQ ID NO: 4264 - protein, 222 aa, Staphylococcus epidermidis
VRSLSMNSRMKIKKAYEYMKSFHQHDTTGHDIAHVERVYNNACYIAKRENITDTLVIELSSLLHDTVDSKLTDEILAYDQLKQFLSTLDLSSEISQQVLYIIKHMSYRAGKNNHVKLSIDGEIVRDADRLDAIGAIGIARTFQFSGHFGEPMWTETKLSNEELHTSLVEELDNSAIKHFYEKLFKLKDLMHTPTAKKLAEERHQFMIQYLKQFMSEWNFNKE

SEQ ID NO: 4265 - protein, 161 aa, Staphylococcus epidermidis
NNMQSTQDYIEMRLPASAEYVSLIRLTLSGVFSRAGASYDDIEDSKIAVSEAVTNAVKHAYKKNSEIGMINLCFEIFDDRIKIVISDQGESFDYEATKSHLGPYNDNENIDFLREGGLGLFLIESLMDEVTVYKESGVTISMIKYIKKEQVRNNGERVEIS

SEQ ID NO: 4266 - protein, 728 aa, Staphylococcus epidermidis
VIFKEKRGRKKQMDNSLIETIVSKYQFSEKQIKAVLKLLKENNTVPFIARYRKEATGGLDEVEIKQINDEYNYMLNLQKRKEEVIHNIDQQGLLTSDLKQDILTQTKLQRVEDLYRPYKQKKKTRATEAKRKGLEDLADWFSQSKLDTKIEDKAQLFLNDEVTTIEDAIEGAKDIIAERISDNPQYRSKILKDVFNQGLIVSSKKKKAEDEKQTFSMYYDYNEPIKRIANHRVLAMNRGEKEKVLSIKIDFDTTRIQREIANVEIKTQNEATPFIKEAIQDSLKRLILPSIEREIRGDLTQNAESHAIDVFSENLRNLLLQPPMKGKQILGVDPAFRTGCKLAVVNPFGTFIAKGVIYPHPPISKVEEAEKELVKVISDYNIELLAIGNGTASRETEQFVAKVIKKYQLQAQFIIVNEAGASVYSASEIARQEFPDFQVEERSAVSIGRRVQDPLSELVKIDPKSIGVGQYQHDVNQKDLSSALTFVVETAVNQVGVDVNTASKSLLQYVSGLTSTIAQNIIDYREENGPIKHHKEISSIKRLGAKTFEQSIGFLRIVDGEEPLDNTAIHPESYDVAYRMLHQLDLTAQDIGSVKLKNTLSNVNISTLVSQLNIGEPTLKDIIQSLIAPNRDPRDEFETPILKSDVLSIEDLSKGMKLNGTVRNVVDFGAFVDIGVKQDGLVHISKLSKKFVKNPMDMISVGDIVEVWILDIDENKGKVSLTMVDPNE

SEQ ID NO: 4267 - protein, 72 aa, Staphylococcus epidermidis
NVNNHKNYMFDDCCLMNFIIRRLINCKVIIDDLNMMMSLFYIINVHIKVILVILDLRYGSKINKKNIFVFFN

SEQ ID NO: 4268 - protein, 341 aa, Staphylococcus epidermidis
SGSKEAHFVEEFTKSYKALVKESLITNNKTLLIKKCEAFTNEVIKKDVLPEDIVEIHKDYINTLDLTEEDILETLDVLQEVVKGFGYSYRDYQRLVNKLQVHDKEMDLASRLQQTMLKADIPQFDSIQIGVISVAAQKVSGDYFNLIDHKDGTMSFAVADVIGSGIPAALAMSMIKFGMDAYGHSQLPSDGLKRLNRVVEKNVNQNMFVTMFYGLYEEMNHLLYCSSAGHEPGYIYRAETEAFEEIGVRGRVLGVSPKTRYSQQEIPIYLDDLIIIFTDGVTEARDVEGNFIDKDKLLDLIQKYKHMHPQDIVQIIYEAILKLQNPARKDDMTILIIKRVN

SEQ ID NO: 4269 - protein, 108 aa, Staphylococcus epidermidis
MNLNIETITHDDFYEVKVGGELDVYTVPELEEVLVPMRQEGTHDVHVNLANVSYMDSTGLGLFVGTLKALNQNDKNLYILGVSERIGRLFDITGLKDLMHVNEGTEVE

SEQ ID NO: 4270 - protein, 61 aa, Staphylococcus epidermidis
RLLKLNIIIFLNSIAFDNLNIELNFNDNLRQYTYFYYDYYILKVNKVLSFCDILANLKEVM

SEQ ID NO: 4271 - protein, 71 aa, Staphylococcus epidermidis
EGMKLKKGLINVSGIKTTEQAKQLKDHLSKMIGINSVDIDYQMNEIRVEFDTPANLNNIEKEIYDYGFRIL

SEQ ID NO: 4272 - protein, 61 aa, Staphylococcus epidermidis
LCLDIVLAKASISIIFMNSEGWMLIGPKLYQLLAPLIIGVIEVSGKISNPINRTQNILYKI

SEQ ID NO: 4273 - protein, 495 aa, Staphylococcus epidermidis
PMIEVFTMALHQSNIIINILLVSAFLLNLVFAFIIIFMERRTANSIWAWLLVLVFLPLVGFILYLLLGRQIQREHIFKLAKEDKVGLEMIVDEQLEALKKQDFSKGNHQIVKFKEMVQMLLYNNAAFLTTDNDLTIYTDGHQKFDDLINDIRHAQSYIHIQYYIIHSDNLGKQLLHELEKKAEEGIEVKMLYDDMGSRDLRKKDLKKFRQKGGHAESFFPSKLPLINLRMNNRNHRKIVVIDGTIGYVGGFNVGDEYIGKSKKFGYWRDTHLRIKGDAVNALQLRFILDWNSQSTRDNLTYESRYFPDVDSGGTIGIQIASSGPDEDWEQIKYGYLKMISSAKESIYIQSPYFIPDQAFLDSIKIAALGGVDVNIMVPNKRDHPFVYWATLKNVASLLEAGVNVYHYDNGFLHSKTLVIDDEVASVGTANMDNRSFTLNFEVNAFIYDEGVARSLKQAFINDMKLSNKLTSEEYAKRNLLVKFKEGISQLLSPIL

SEQ ID NO: 4274 - protein, 124 aa, Staphylococcus epidermidis
YTKEAIQVIYGIGIDLIEIERIKNLQNQTKFIERILTIEERDKLNQYTNEQRRLEFLAGRFTVKEAFSKALGTGLGKSVSFQDINCYNDALGKPCIDYPGFYTHVSITHTENYAMSQVILEKNE

SEQ ID NO: 4275 - protein, 173 aa, Staphylococcus epidermidis
KVILMKSYKYMHQNGIKVMRISGAFWTLLLVIALSILILLNELKFHFIDTKNLIIGVIILTTIVCILFMIIVPWFKFKHLRYFLDDKEIHIREGIIFIDVHVIPYFRIQNIDIVEGFIMRKFQLASLSLSTAGGNSEIALIDIQEAQRLKKQIKQQKSITTNVTSLEKLNDDI

SEQ ID NO: 4276 - protein, 91 aa, Staphylococcus epidermidis
GMTCTSIKMIPSLICISLSSKKYLRCLNLNQGTIIINKIQTIVVKIITPIIKFLVSIKWNFNSLSNIKIDNAITSKSVQKAPLILITLIPF

SEQ ID NO: 4277 - protein, 263 aa, Staphylococcus epidermidis
KKSRCEIMAKESKSASEVSPEQINQWIKQHQENEDSQAQDKLVKHYRKLIESLAYKYSKGQSHHEDLVQVGMVGLIGAINRFDLSFDRKFEAFLVPTVIGEIKRYLRDKTWSVHVPRRIKEIGPRIKKVSDELTNELERSPSISEIAQRLEVSDEEVLEAMEMGQSYNALSVDHSIEADKDGSTVTLLDIMGQQDDNYDLTEKRMILERILPILSERERQIIQCTFIEGLSQKETGERIGLSQMHVSRLQRTAIKKLQEAARQ

SEQ ID NO: 4278 - protein, 360 aa, Staphylococcus epidermidis
VVSRRTYMSEKFYRATYLNVNLDAILANYQNFNQLHANKTVISVIKANGYGLGSVKIAQHLMRHGATFFAVATLDEAIELRMHGVDAKLLVLGVVPTEDIEKAIQHRVALTVPSKAWLKETIKQIPDDNQKNLWLHVKLDTGMGRIGMKDIDEYKEVVDLINKRDHLVFEGVFTHFASADEPGNSMNEQYTLFKEMVNQVEKPNYIHCQNSAGSLLMDGQFCNAIRLGISLYGYYPSEYVKDNVKVHLRPSAQLVSETVQVKTLKAGETVSYGRTYIADEEMTIAILPIGYADGYLRSMQGAFVNVNGSQCEVIGRICMDQLIVKVPSHVKTGDKVILMDNHVDSPPSAETVPNKQGRTN

SEQ ID NO: 4279 - protein, 166 aa, Staphylococcus epidermidis
ILKRSTFMKNDSTFHRSPIQALKYYYITSCIGLFILLVILSLLLYFSYLNHWWPFTSYIFLGLGLLSILNTCISPLIKYRYHYYKIHEDFVILKRLFIFRKEELSKIERIQFIDIGTNPLSKKLNLNSITLFTAGHTISFPIISEKEAQNIQQQILLRLRGANDDV

SEQ ID NO: 4280 - protein, 120 aa, Staphylococcus epidermidis
MIRRGDVYLADLSPVQGSEQGGVRPVVIIQNDTGNKYSPTVIVAAITGRINKAKIPTHVEIEKKKYKLDKDSVILLEQIRTLDKKRLKEKLTFLSESKMIEVDNALDISLGLNNFDHHKS

SEQ ID NO: 4281 - protein, 278 aa, Staphylococcus epidermidis
LLIGLSGCDYSTPEKQDGFFFNTFVQPMKHLLQWLGNDVFHNNFGLAIIVLVLFIRLILLPFMLSNYKNSHMMREKMKVAKPEVDGIQEKVKRARTQEEKMAANQELMEVYKKYDMNPMKSMLGCLPILIQMPIIMGLYFVLKDKLVNGLSEHPHFLWFNLTKPDIWITVIAGVLYFIQAVVSSKTMPQEQRQMGYMMMVISPIMIIWISLQASSALGLYWSVSALFLVIQTHFANIYYSKLAKKEVQPFIEKYEREHNPSSKKKGKNTQVVSKKNKK

SEQ ID NO: 4282 - protein, 506 aa, Staphylococcus epidermidis
EVQMTMYSPQKLHPISYIDGLISVIKSNFIVIIIFLFNIKDFKYDDFSSYIIPGIMTLIFSIGFIHNIIKVYNTRYWIEEDHFILTTGVFNKERKELNISRIQSADTSQGLINQIVGGVELIIKTPSDGIELGTISKKQSEVIEQELRSIQERMNNQVNQEAKELNDENHTQTYQQHAKPQYAIFKMPFKQLLFMSMTSGAIALAFVTLSPIIGSLSSVIPWDKFGEEISSVFKTIYFIVIFIVILVLLLSYIIGTIMYLIKFYGYQVIQDNHQLKIQYGLFTKKNITVPTDRLQGVLEHQSFIRKLFGYTSIHFYITSDIDTTEGEPTDNDGRIMILPFIPRKEAYKVIRPLVPEMTFNHAKIGMPLKGFHRHFLIPSLCIIGMGIIGWYMWSLWSLIIALLPILLFFVYAILYTRFSGFAFSESELVVQKASILNIKRFYVKKEKVLGMAISQHPFLERSQLANFQFVIAKGSSQQNIGLKFSEVDNVLKLKNWYMKGDTHEVL

SEQ ID NO: 4283 - protein, 68 aa, Staphylococcus epidermidis
YNNFWNQMEVLFMLSFNQNRNHSLEQSLKEGYAQMADLNLSLATEAFPIECEACDCNESHLISNSKNE

SEQ ID NO: 4284 - protein, 457 aa, Staphylococcus epidermidis
LLEVLVMINVTLEQIKNWIDCEIDEKHLKKTINGVSIDSRKINEGALFIPFKGENVDGHRFITQALNDGAGAVFSEKENKYSEGNQGPIIWVEDTLIALQQLAKAYLNHVNPKVIAVTGSNGKTTTKDMIESVLSTEFKVKKTQGNYNNEIGMPLTLLELDEDTEISILEMGMSGFHQIELLSHIAQPDIAVITNIGESHMQDLGSREGIAKAKFEITTGLKTNGIFIYDGDEPLLKPHVNQVKNAKLISIGLNSDNTYTCHMNDVKNEGIHFTINQKEHYHLPILGTHNMKNAAIAIAIGHELGLNETIIQNNIHNVQLTAMRMERHESSNNVTVINDAYNASPTSMKAAIDTLSGMKGRKILILADVLELGPNSQLMHKQVGEYLKDKNIDVLYTFGKEASYIHDSGKIFVKEAKYFDNKEQLIQTLISQVKPEDKVLVKGSRGMKLEEVVDALL

SEQ ID NO: 4285 - protein, 738 aa, Staphylococcus epidermidis
YFRLVHNKDKLMRCMYSMQTRLGEKDINLPQYYNNRELSWLDFNYRVLQESYDKNNPLLEKLNFISIFSSNLDEFFMVRVAGLKDQVKMGYDKPENKAQMTPQEQLDAIKIKNTDYVNTQYQRYNELIKELANYDIEMVKPEDLSDALIEKLEQEFKLSVLPTLTPLGIDAYHPFPKLNNKSLNIFVDIDTEDAINSAIVQIPSLIPRFLTLNEGTKQYVVMVEDVITYFINYLFTGYEVLNTFTFRITRNADLTIHEDGAEDLLIEIERFLKERKSGSAVRLELDCRTSEKENVEWLINQLEIEDNDIYYLDGPLDLTFLFGLVDHLSHKLKYLTYEKYTPQPPRSLGNKNIYQLSLERDIFFHHPYESFEPIVDFIRQAADDPNTIAIKQTLYRVSKDSPIINSLKEAAENGKQVTVLVELKARFDEENNVHWARMLEDAGCHVIYGMTHLKTHSKIALVVKRINNELTSFVHLGTGNYNDKTAKLYTDMGIITTNKDIAEDAINFFNYLSGYSTKPEYNKLIVAPYDIRDVFIDRIDKEIRSHLQHGNGKIMMKMNSLTDKTIIEKLFEASQAGVKIQLIIRGICCLKPGIPGISENIEVVSIVGRLLEHSRIYYFHNNSEAHIYLSSADVMTRNMIKRVEILFPVEDKSIGQRLVNYMNLQLSDNQKGRYQDAQGLYHYVENNSSPLNSQSYLMQEAIKYGEELKKQSVQPSGQPVHSRRGGSWMRKLKNTFKR

SEQ ID NO: 4286 - protein, 196 aa, Staphylococcus epidermidis
TAISFKRGKLIMNIYNKVTLSVILVITIIISFLFYFYTTEKKVDKDKLYENKITNHKQAGKPKNYGVASNNKIATKVGNKIIEDGGNAVDAAIGVSYALAVTEPHSSGLGGGGATLTYNGKENETPKAYEYKTMSSYEYKEGDKIGVPGFVRGLHDMHAKEGKMDEKKILDYVIPLAKDGFEVDSELVKKFEIIWS

SEQ ID NO: 4287 - protein, 76 aa, Staphylococcus epidermidis
FEVSFCLFLRLCSIFLSFLLEFVWWLIAAYNEKPNAHIRMITTIVAENFFKAYILHPFYQLYFIIILFFIVSRIIL

SEQ ID NO: 4288 - protein, 129 aa, Staphylococcus epidermidis
IAGFVLHCIKFHINKPTNNNPVPGNNKLRIIIIIINIEIEIINQRLLVNLSDKTPPNEVPITPATPLTSSAKDTKDISCPLDKINGLINTNVTELATSTKNVIIRYLKTSRGLMTLEPVCDSILDERGV

SEQ ID NO: 4289 - protein, 274 aa, Staphylococcus epidermidis
IGGLTMIKAIAVDMDGTFLDTNKQFDRNRFETIFKELIDKNIKFIAASGNQFAKLKSIFGDREMFFISENGAVIYKGNQLYNYRSFDQYIFQKVVNYLNLNQKINNLIICGVKSAYILKETSEAFKQDARTYYHQLIEVDSLQTLPDDDYVKIAFNINRQTHPDLDEKLALKFKDDIKLVSSGRDSIDVIMPNMTKGQALSRLLKEWQMPASHLMAFGDANNDKDMLELAEHSYVMANSEDQSLFDIASHVAPSNDEQGVLSTIENVVLGYSNK

SEQ ID NO: 4290 - protein, 521 aa, Staphylococcus epidermidis
LSESANSFYLHVDDFLIRIVKECLLTHVNSKLMLWRFVMGSFFNRMTRKENPTIYQSKDGHLKRTLRVRDFLALGVGTIVSTSIFTLPGVVAAEHAGPAVSLSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALAILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRK

SEQ ID NO: 4291 - protein, 66 aa, Staphylococcus epidermidis
IALSSAFSLANMIVKITVMVANIPPMRIADPRKSASSGAIGKFIDKQNVTKKNVDDGPAIFSALNV

SEQ ID NO: 4292 - protein, 103 aa, Staphylococcus epidermidis
YNMSFNIWMWILLVLFIVGTIAVILILTVGSVLEERSYDRRSEDEKRKNLEKNLEMSKGHTDVSQESSNGEEQVTQEHSQHVVQDHQQTHQNINQSTQDNRNN

SEQ ID NO: 4293 - protein, 74 aa, Staphylococcus epidermidis
LYASGVKVAIPVLGSYVADPDRFICSLKLSLFTTTELDVRLEVVVVDVVVGAAIVFKTVNLLNVLKFAKEVGLD

SEQ ID NO: 4294 - protein, 485 aa, Staphylococcus epidermidis
HLTLTYIEGETMSGKLEELQLKVARLSRRTHELGIPIMVLFEGIPASGKTRLSNELLLHLDAKYSRFIATKSPESNDLRYQFLQKYWNTLPQKGNINIYFRSWYSHFLDYKENKIKHDQYKNYDVLVNQIYHFESMLKNDNYEIIKFFIEINEEKRNEHIQQTKDNPLTRWKVQEYENVIPQESYLNQMHQFINKDKDWKVIDYTEREHAFEKMYLHLIDRLEQAIKKVEQQTTKVNGKFTSSFTTSLFNNNLEKVDKKTYKNLIVELQQRMREIQFALYERKIPLVLVFEGMDAAGKGGNIKRIREKLDPTGYEVNGISAPTDVELKHHYLWRFAKKMPKSGHIKIFDRSWYGRVLVERVEGFASQNEWQRASDEINQFEKMWTDEGTIILKFFLCLDKDEQLKRFKDRENNPDKQWKITEEDWRNREKWDEYLEASHDMIESTNTSYAPWYIVPADHKKTSRIEVLKTIIRKCEEVLWGVKTY

SEQ ID NO: 4295 - protein, 436 aa, Staphylococcus epidermidis
FKTFHNFCKALTYLLYIPGHVCYISLYKTNFLWYDTSATSKNERMSHLMNIGIDKISFYVPKYYVDMAKLAEARQVDPNKFLIGIGQTEMAVSPVNQDIVSMGANAAKDIITEEDKKNIGMVIVATESAIDNAKAAAVQIHHLLGIQPFARCFEMKEACYAATPAIQLAKDYLAQRPNEKVLVIASDTARYGIHSGGEPTQGAGAVAMMISHNPSILKLNDDAVAYTEDVYDFWRPTGHQYPLVAGALSKDAYIKSFQESWNEYARRHNKTLADFASLCFHVPFTKMGQKALDSIINHADETTQDRLNSSYQDAVDYNRYVGNIYTGSLYLSLISLLETRDLKGGQTIGLFSYGSGSVGEFFSGTLVDGFKEQLDVERHKSLLNNSIEVSVDEYEHFFKRFDQLELNHELEKSNADRDIFYLKSIDNNIREYHIAE

SEQ ID NO: 4296 - protein, 696 aa, Staphylococcus epidermidis
SYLFMLFLWHVNKKIERNELIMFKKLFGQMQRIGKALMLPVAILPAAGLLLAIGTAFQGEALQHYLPFIKNDIVQQIANMLTGAGGIIFDNLPIIFALGVAIGLAGGDGVAAIAAFVGFIILNKTMGAFLHVTPDKLSDPTNGYANVLGIPTLQTGVFGGIIIGALAAWCYNKFYNITLPSYLGFFAGKRFVPIMMATTSFILAFPMAIIWPTIQNGLNAFSEGLLDSNTGVAVFLFGFIKRLLIPFGLHHIFHAPFWFEFGSWKNAAGEIIRGDQRIFIEQIREGAHLTSGKFMQGEFPVMMFGLPAAALAIYQTAKPENKKVVAGLMISAALTSFLTGITEPLEFSFLFVAPFLFVIHAVLDGLSFLTLYLLNVHLGYTFSGGFIDYVLLGILPNKTAWWLVIPVGIIYAVIYYFVFRFLIVKFNYKTPGREDKKSSVTTTSASQLPFDVLKAMGGKENIKHLHACITRLRIQVNEKSKVDVAGLKSLGASGVLEVGNNMQAIFGPKSDQIKHDMAKIISGEITKPSETTIDEEVSDESVHVEDIVETEIYAPGHGEIIPLSEVPDKVFSEKMMGDGIGFVPDSRKIVAPFDGTVKTIFPTKHAIGLESDSGVEVLIHIGIDTVKLNGEGFESLVNTDEPVTQGQPLMKIDLEYLKEHAPSIITPVIITNQEDKTLTIEDVKQVDPGKAIMTIK

SEQ ID NO: 4297 - protein, 529 aa, Staphylococcus epidermidis
GVLFMSVLTVMQFIVNIIIMIVLLTIMILGGIWLFKDKGQNQHSVLRNFPVLGRIRYISEKIGPELRQYFFANDNEGKPFSRSDYKNIVLAGKYKSRMTSFGTGKDYLEGFYIQNTMFPLQATELHIDHTEFISTFLYHIENERLFSREEYRKSAQVDPFFLTDEHAVVLGSNLKHPFKIKRLVGQSGMSYGALGKNAITALSMGLAKAGTWMNTGEGGLSEYHLKGNGDIIYQIGPGLFGVRDHDGNFNRDMFINLAEHNNVRAFEIKLAQGAKTRGGHMEGNKVTEEIARIRNVKPYETINSPNRFDFIKNPTDLLNFVNHLQSIGQKPVGFKIVVSKVEEIEALVKTMIEIDTYPSFITVDGGEGGTGATFQELEDGVGLPLFTALPIVSSMLEKYGIRNKVKIFASGKLVTPDKIAIALGLGADLVNIARGMMISVGCIMSQQCHLNTCPVGVATTDPKKEKGLIVDEKQYRVTNYVTSLHEGLFNIAAAVGVHSPTEITSDHIIYRQLDGTTTSIQDYKLKLIS

SEQ ID NO: 4298 - protein, 387 aa, Staphylococcus epidermidis
SRLLLIIACVALILWLGIKEKKRHANRLEKIPLRININGIRGKSTITRMAYSVLREDQYRVVGKTTGTDARMLYWFTEKEYPVIRKPQGANIGEQRDIIRKVVKQKANALVNECMAVNPDYQITFQNDLVKANIGVIVNVMEDHMDVLGPTLKDVAQAFTATIPYNGKLVVMKDNYTSFFVKEAKKRNSELIVVDKDVIPESYLRKFDYLVFPDNVAIVLGIAQAVGVDEETALQGMLNAPADPGAVRIKYFHANRTKNVFVNAFAANEPQSTKAILNKVESYNYPYDKKIIILNCRSDRVDRTQLFVDNFLGEVDYDVLICTGKSTQMVTQFMETMPEKTYINYEGRDFVEIEKGILHEAENALVFCVGNIHGPGGRIAEFIEGIE

SEQ ID NO: 4299 - protein, 248 aa, Staphylococcus epidermidis
EGAPLMSIERIIYDNFQNDPFINELDINDETKGAYEILKWAYQTYENDIVYSCSFGAESMVLIDLISQIKPDAQIVFLDTDLHFQETYDLIDRVKDKYPQLRIKMKKPELTLEEQGEKYNPALWKNDPNQCCYIRKIKPLEDVLSGAVAWISGLRRAQSPTRAHTNFINKDERFKSIKVCPLIYWTEEEVWSYIRDKDLPYNELHDQNYPSIGCIPCTSPVFDSNDSRAGRWSNSSKTECGLHVADKP

SEQ ID NO: 4300 - protein, 462 aa, Staphylococcus epidermidis
ATTLYVKVCSNMVQVKIGNCTINGIHKKNIDVFLGIPYAKSFNKISRFQHSKLMELSKPMIDATHIQSIPPQPYNSLEDFFSMTDSSFNSFKQNDYCLFLNIWKPSSNQNHLPVVIYFYGGSFLQGHGTAELYCPEHIVEQENIIVVTFNYRLGALGYLDWSYFNQHLNYNNGISDQINVLRWVHQYIEHFGGDPNNVTLMGQSAGSMSIMTLMQMPELDDYYHKVMLLSGTLTTDTPLNAHTKVQHFSQLMRHYFPNKTLKTLNSDDILYLMESQKIERGRSRGLDLIYQPIKDHHMSRSIKKFPKPTFMSYTHDEGDIYIEDATRTLPSERFIHLMSQYGTHVEKNDALTMKQQRNVITEYCFVRPIYLFLNQMNSCDTWLARFDWHQPHTSYFKSAYHILDLVFWFGHLSILTKNHYSVTQHDMNLSRNMISDLAYFARKGKMPWKCYEPQHQALHIYR

SEQ ID NO: 4301 - protein, 135 aa, Staphylococcus epidermidis
KGVLLMEKAKFVIKLILQLALIMLITFIGTEVQKLLHIPLAGSILGLMLFFLLLQFKIVPESWINVGADFLLKTMVFFFIPSVVGIMDVASNITMNYILFFIVIIIGTCLVALSSGYIAEKMLEKSNTRKGTDHS

SEQ ID NO: 4302 - protein, 430 aa, Staphylococcus epidermidis
IVTFEFNHFTQRMGYQLDKRQFEILDMLVRFNTESPPGRNTDPLQDEIETLLKQLDFSIQREQLYDNDSVIVATLKGHNPKAPKLILNGHVDVASVDDDQYWQYPPFKLTNKDEWLYGRGVSDMKGGMSSLFYVLEQLHQAGQRPEGDIIVQSVVGEEVGEAGTKRACEIGPKGDLALVLDTSENQALGQGGVITGWITVKSKNTIHDGARSQTIHAGGGLFGASAIEKMTKVIQSLNELERHWGVMKKSPGMPPGANTINPAVIEGGRHPAFIADECRLWITVHYLPNESYESVVNEIERYLNKVAEADVWLRENPLEFEWGGTSMIEDKGEIFPSFTVPTHHPGFKQLEEAHEHIHNKKLEHGMSTTVTDGGWTAHFGIPTILYGPGSLEEAHSVDEKIKAKELAQYSDVLYTFLKEWYEHPQSYKSS

SEQ ID NO: 4303 - protein, 661 aa, Staphylococcus epidermidis
MYAFTIIVRKRSVHTMKILAITSCPNGIAHTYMAQEKLEQAAKDMGVDIKVETQGGVGAENVLTSKEIKEADGIIIAADRQVDLSRFNGKPLINESVREGIHRPKELIQRVIDQDAQIYHDQNISSNISRDQEEPHKSNIQMVYQHLMNGVSFMVPFIVVGGLLIAIALTLGGHTTPKGLVITEDSFWKSIENIGSLSFKFMVPILAGYIAVSIADKPGLVPGMIGGAIAADGSLYGSEAGAGFVGGIVAGFLAGYIAKWIKQIKVPKAMAPIMPIIIIPILSSLIVGLIFIFVIGTPISNIFGALTSWLKGMQGANIIILALIIGAMIAFDMGGPVNKVAFLFGSALITEGNYTVMGMVAVAVCTPPIGLGLATFVRKHQFNKAEQEMGKASFTMGLFGITEGAIPFAAQDPLRIIPANMIGAMIASVIAAVGGVGDKVAHGGPIVAVLGGISNILWFFIAVVVGSLVTMFTVLLFKRHTPAIAKSNNGNDTSVGTENVFSDDQSINHSKQLSHHMVFDKSLIEITKEPMTRDQAIDRLLTKLCHRHYITNIEEVRTAILKREAESTTAIGMNVAIPHAKSHAVKRPIVAVLNHKAGVEWESLDESNPQLIFLIAVPNDNNDTHLKLLQRLSRTLMKDNTRDELIHAQSRDEIFNILKEI

SEQ ID NO: 4304 - protein, 344 aa, Staphylococcus epidermidis
QKKPKHLFNNTTKSIGRLAGNDESLKLNLRDMFSEVFKSHTKDEADDVFIAGTKRTTPHINEVSEEWGRPWVFSRVFLALGITFLALWILTNIFDNANAIPGMIFIGALLVPISGLIFFFESNAFKNISIFDVMRMFFIGGVLSLISTMILYQFVTFSTESQYYGIMTITDAFIVGFVEELGKATVVILFINYLKTNKILNGLLIGAAVGAGFAVFESAGYIFRFGFNLFDGANNITEITIQRGWTALGSHLVWAAIVGAAAVIVKETKHFEWANIIDKRFIFFFFVAVTLHGIWDTEITLLSSGYLKYILLIMIAWLFIFILMKAGLTQVNQLRDEYNRLEER

SEQ ID NO: 4305 - protein, 301 aa, Staphylococcus epidermidis
KEQLTEDNVQSIEGFDGLSLSQTLPLSETIYNKLNQLGIRQIAQRSAGFDGYNLELASKYGLIISNVPSYSPRSIAEFTVTQAINIVRHFNHIQRKMRLHDFRWEASILSQSIKDLKVAVIGTGHIGGIVAQIFSEGYLCDVVAYDPFPSEHVKPYVTYKQSINEAIKEADIVTIHMPSTQYNNYLFNENMFQMFKKGAVFVNCARGSLVDTKALLSAIEQGQIKGAALDTYEYEIGVYTTDRSEEGLNDPLLEELITREDIIVTPHIAFYTEEAIKHLIFDALDATMEVLNTGTTELRVN

SEQ ID NO: 4306 - protein, 156 aa, Staphylococcus epidermidis
YIKLSVIQKQGVFIMANSIYSTTMISNGGRDGRVFSPDNTFVQNLATPKEMGGQGGNDTNPEQLFAAGYSACFNSALSLILSQNKISDANPEVEITIELLKDDTDNGFKLGADIKVTLENMSQQDAEKFVEQAHQFCPYSKATRGNIDVQLDVTAQ

SEQ ID NO: 4307 - protein, 70 aa, Staphylococcus epidermidis
NVKLLITEGGLFMFTISIIAMIIGVVLIVLSQIIYHSKPIDAKEKMFIPGVCLFLVGLLSLIGHFVNGYV

SEQ ID NO: 4308 - protein, 282 aa, Staphylococcus epidermidis
LCEFESEGKISMNTLDSKYELKSKKHRQRIIKNWVIVTVVAAVIIWAFAGIPGLELKSKSIEILKSIFYGLFHPDLSYIYIPDGEDLLRGLLETFAIAVIGTFIASIICIPFAFLGAKNMMKLRPVTGISKFILSIIRVFPEIVMALIFIKAVGPGSFSGVLALGIHSVGMLGKLFVEDIESLDFSAVESLKASGANKMKTLMFAVIPQILPSFISLILYRFELNLRSASILGLIGAGGIGTPLIFALQTRSWDRVGMILIGLIAMVALVDLISGAVRKRIV

SEQ ID NO: 4309 - protein, 482 aa, Staphylococcus epidermidis
KAYTFSIPPSKGEMNMNDTGDKRLSRTSLIGLVIGSMIGGGAFNIQSDMGGHAGGLAIIIGWLITAIGMISLALVFQNLTNERSDLDGGIYSYAQAGFGDFIGFASAWGYWFSAFLGNVAYATLLMSSIGNFFPIFKGGNTFPSIIVASILLWSVHFLILKGVETAALINSIVTITKLIPILLVIICMIVAFNFNTFRIGFFGMDGYGSLSFHFANTMSQVKSTMLVTVWVFIGIEGAVVFSGRAKNKKDVGTATVIGLISVLLIYFLLTVLAQGIVIQNHISKLEAPSMAQILAYIVGDWGATFVNIGLIISVLGAWLGWTLLAGELPFIVAKDGLFPKWFAKENKNGAPMNALFITNVLVQIFLISMLFTKSAYHFAFSLAASAILYPYMFSAFYQVKYTIEYKLTATPKQWIIGILASIYAIWLVYASGIDYLLLTMLLYIPGIIVYVVVQKNNQKRLTQFDYIFFGLIVILALIGLLR

SEQ ID NO: 4310 - protein, 794 aa, Staphylococcus epidermidis
MANTTLTLDIIGMTCAACSNRIEKKLNRMNHVQAKVNLTTEKATIDYESDDYHLEDFVEQIQSLGYDVAVEQVELNINGMTCAACSNRIEKVLNQTQGVQQATVNLTTEQALIKYYPSATNTEALIKRIQNIGYDAETKTSSKAQSNRKKQELKHKRNKLIISAILSLPLLLVMVVHISPISIPSILVNPWVQLILSTPVQFIIGWQFYVGAYKNLRNGSANMDVLVAVGTSAAYFYSIYEMMMWLTHQTHHPHLYFETSAILITLILLGKYLEARAKSQTTNALSELLNLQAKEARVIKENKEIMLPLDKVKVGDTLLIKPGEKIPVDGKVTKGDTSIDESMLTGESIPVEKSSGDSVIGSTMNKNGSIMIEATQVGGDTALSHIIKVVEDAQSSKAPIQRLADIISGYFVPIVVSIAVITFIIWIIFVHPGQFEPALVSAISVLVIACPCALGLATPTSIMVGTGRAAENGILFKGGQFVERAHYVDTIVLDKTGTITNGQPVVTDYVGDNDTLQLLASAENASEHPLADAIVTYAKDKGLNLLDNDTFKSIPGHGIKATIHQQQILVGNRKLMNDYNISISNKLNDQLNHYEHLSQTAMMIAVDNQINGIIAVADTVKNDAKQAIKELRNMNIDVVMLTGDNNRTAQTIAKQVGIEHVIAEVLPEEKAHQISLLQDKGKQVAMVGDGINDAPALVKADIGMAIGTGAEVAIEAADITILGGDLLLVPKAIKASKATIKNIRQNLFWAFGYNVAGIPIAACGLLAPWIAGAAMALSSVSVVMNALRLKKMKL

SEQ ID NO: 4311 - protein, 69 aa, Staphylococcus epidermidis
TKLTRCLMYKDYNVTQLTLPMKTSFFIPANDISRHANDIVETIPETEFDELRHHRGATSYHSKMILKEL

SEQ ID NO: 4312 - protein, 98 aa, Staphylococcus epidermidis
KWITPILFIDIVIFTPIIEELLFRHLIIHELGKKLTYGLMYIVSIVGFTYFHCTDAVSPFEAGPYFIAAVVFVIGYHFSHRNLAVPIALHMITNLIAF

SEQ ID NO: 4313 - protein, 74 aa, Staphylococcus epidermidis
NFSTPFTYIYVYVRNNYVSVSQTTTREDYIMSGIVESLHNAVNAGLHVKQDWVDMGFGIADTVAKIVDQVLKFV

SEQ ID NO: 4314 - protein, 806 aa, Staphylococcus epidermidis
THQTITGVIRMAKGVNQIINNIRLRKLRKILNQINALSEEFSNFSDEALQAKTKEFKVYLNDNKASLNHILPQAYATVREASKRVLGMYPKDVQILGAIAMHQGNIAEMQTGEGKTLTATMLLYLNALTGKGAYLITTNDYLAKRDFLEMKPLYEWLGLSVSLGFVDIPEYEYAENEKYELYHHDIVYTTNGRLGFDYLIDNLADDIRAKFLPKLNFAIIDEVDSIILDAAQTPLVISGAPRVQSNLFHIVKTFVETLEKDKDFIVNFNKKEVWLTDEGSEKASHYFKVNSIYQQQYFDLVRMIHLSLRAKYLFKYNLDYFIFDGEIVLIDRITGRMLPGTKLQSGLHQAIEALENVEISQDMSVMATITFQNLFKQFDEFSGMTGTGKLGEKEFFDLYSKVVIEIPTHSPIERDDRPDRVFANGDKKNDAILKTVIGIHETQQPVLLITRTAEAAEYFSAELFKRDIPNNLLIAQNVAKEAQMIAEAGQLSAVTVATSMAGRGTDIKLSKEVHDIGGLAVIINEHMDNSRVDRQLRGRSGRQGDPGYSQIFVSLDDDLVKRWSNSNLAENKNLQTMDASKLESSALFKKRVKSIVNKAQRVSEETAMKNREMANEFEKSISVQRDKIYAERNHILEASDFDDFNFEQLARDVFTKDVKNLDLSSERALVNYIYENLSFVFDEDVSNINMQNDEEIIQFLIQQFTQQFNNRLEVAADSYLKLRFIQKSILKAIDSEWIEQVDNLQQLKASVNNRQNGQRNVIFEYHKVALETYEYMSEDIKRKMVRNLCLSILAFDKDGDMVIHFP

SEQ ID NO: 4315 - protein, 524 aa, Staphylococcus epidermidis
NIKTHSRGECMSKILLTGASGYIGNHLKNKLKKDHEVIAISRNTHNKTDEENVTWKSADLFDLDEVTKVMKDVDTAIYLVHSMMPSAKLTQASFEDMDALLADNFARAAQKQGVKHIVYMSGLIPENDELSAHLRSRLECEKILGDYGIPVSTLRAGLIIGAKGSSYPILKRLVERLPAMVLPSWAYNKIAPVAIDDVIDGLAALVNRTPKDNEAIDITGPEVMNYKTLIQRTANVLDKRLPMLDLPIIPIIVSRYWVQLISNVPKEMVYPLMNSLTHDMVPHRKRVVSNLSVGNITFEDSVKRALREEQKTSKKKSDSKNSQSFGLMHQEIKDVRAITRFKIPEGYSIKDVTKEYAKFINNITLHIVKGTINEREFNMNLPFINKFILKMERDEADSTEDMVVYNIVGGDLAHSNDGGNARFEFRRIRNTNEGIIALQEYEPTLPWVVYKLTQAKAHKTVMNIFKNKMARLAQQKNVKDETYMSNRVTIGVTVASAFVIGSAVGFQLFKKHQIKKNTMSNAEL

SEQ ID NO: 4316 - protein, 389 aa, Staphylococcus epidermidis
KMKTVSKYFVYMMILVTFFIVVSGCSINQSFSDKQNTNKTIRVVAVGDNLIHPVVYKDAQITGNSFDFKPMYQPVKKDIQNADISFVNQESPLGGDDRPYSGFKNFNTPSSIAQDLVDTGFNFVNGANNHALDQGEQGVRNHIHTWNKFKYQVLFTGVYESEQAHRQIPIKTIKGVKVALLSYTFGTNDHQPTHDYTVDTFDENKIKQDVKKAKQQSDVVLVSAHWGNEGKHQPNATQKKYAQIFADAGVDVVLGTHPHVIQPVKWVDGREGNRTLVAYSLGNFLNGQSTGNESNDLLGRIDFKISKKDKQFQVQDVKWRSMVNYYELTQHQNQFLKSNFKVMMLDDYNDKDATHHGRNQMDSSSMSPAHLRDITRSVIDKQYLDNRSL

SEQ ID NO: 4317 - protein, 241 aa, Staphylococcus epidermidis
VDRTINDRSGYKMNYSPKQGVKSHGLPHDPFKSSTVPRPIGWISTVSKEGKDNLAPYSQYQNLTWDPPMVMFAANQSVLGDHERKDTVKNAEETGWFVWNMATYDLREAVNLSSKALPPEDDEFDFAGVTKESCIEAPGSRVKESPVHFECEYVQTVRIPTGDPVSTVDVVIGRVAQVHIDDKVIMDNGKLDIKSIRPIARLGYYDYTVVDEIFEMKAPAASKEELAGLEGRNFDNTNNES

SEQ ID NO: 4318 - protein, 676 aa, Staphylococcus epidermidis
MKRTDKIGVYLKLSCSALLLSGSLVGYGFTKDAFADSESTSSNVENTSNSNSIADKIQQAKDDIKDLKELSDADIKSFEERLDKVDNQSSIDRIINDAKDKNNHLKSTDSSATSSKTEDDDTSEKDNDDMTKDLDKILSDLDSIAKNVDNRQQGENSASKPSDSTTDEKDDSNNKVHDTNASTRNATTDDSEESVIDKLDKIQQDFKSDSNNKLSEQSDQQASPSNKNENNKEESSTTTNQSDSDSKDDKSNDGRRSTLERIASDTDQIRDSKDQHVTDEKQDIQAITRSLQGSDKIEKALAKVQSDNQPLDSNYINNKLMNLRSLDTKVEDNNTLSDDKKQALKQEIDKTKQSIDRQRNIIIDQLNGASNKKQATEDILNSVFSKNEVEDIMKRIKTNGRSNEDIANQIAKQIDGLALTSSDDILKSMLDQSKDKESLIKQLLTTRLGNDEADRIAKKLLSQNLSNSQIVEQLKRHFNSQGTATADDILNGVINDAKDKRQAIETILQTRINKDKAKIIADVIARVQKDKSDIMDLIHSAIEGKANDLLDIEKRAKQAKKDLEYILDPIKNRPSLLDRINKGVGDSNSIFDRPSLLDKLHSRGSILDKLDHSAPENGLSLDNKGGLLSDLFDDDGNISLPATGEVIKQHWIPVAVVLMSLGGALIFMARRKKHQN

SEQ ID NO: 4319 - protein, 201 aa, Staphylococcus epidermidis
NGGTRMIQRKGELILSWIGNGLHLLYVFLVGIFFIMTQTSEFKNGMIQGFIEENPGEYDLAYQTYNLMLGLGVVFIIILLILLIVSIVAAILIGKNAKVSGILLVITGIIGLFLSFIAGALWLIAGIMLLVRKPQTQNDQINSQYSNDIHSHVVPEEKKREQQQYNMNEPHIGQSSTSHHDHALNDQNKRENHNHDNQPYK

SEQ ID NO: 4320 - protein, 400 aa, Staphylococcus epidermidis
KGGTTTMLTVGIIPSPGIAHQHVKKIIPNVKQLLSKRTKHSQWNFDIKVDLMIGSAEDVHESVEKAAQIKEEHQWDYVVCLTDLPSISDNKVVVSDFNSDKHVAMLSLPSLGFIDLKRKLVKTMTSLIEQLYYNQPKDKNAPHPFVRVKAVEPDEDATSKQRYINILFIISWIQLIGGLTRANQPWKNIFNFKKIISVAFATGTYVSIFSMPWELSVIYSPLRLIILMVIAILGMAGWLFYAHQLIEKKTAKSQRVYRYIYNSTTLVTLSLITLINYVILYLLLIISITLFVPVELFNSWTSAQSQFTFSNYMRLIWFVSSLGLLAGAMGSTVENEEKIRRITYSYRQYHRYKEAEQEQKEQETSRDVSQQNVEQQTSSKDENNEQYEGKKQGHREEDDA

SEQ ID NO: 4321 - protein, 288 aa, Staphylococcus epidermidis
SNMTKVITTINEMQSIVKQHQREGKTIGFVPTMGALHDGHLTMMKQSVSENDLTVISIFVNPLQFGPNEDFDAYPRQLDDDVAAVKKLQVDYVFHPSVDEMYPEELGIHLKVGHLAQVLEGAQRPGHFEGVVTVVNKLFNIVQPDYAYFGKKDAQQLAIVEKMVKDFNLPVHVIGIDIVREKDGLAKSSRNIYLTSEERKEAKHLYQSLRLAKNLYEAGERDSNEIIGQIAAYLNKNISGHIDDLGIYSYPNLIQQSKIHGRIFISLAVKFSKARLIDNIIIGDDYID

SEQ ID NO: 4322 - protein, 656 aa, Staphylococcus epidermidis
LCMTHITESEMKQKYLDLLSQKFDSAEKLATEIINLESILELPKGTEHFVSDLHGEYESFQHVLRNGSGNVRAKINDIFKDKLSQQEINDLAALVYYPEEKLKLVKNNFDSIGTLNIWYITTIQRLIDLITYCSSKYTRSKLRKALPEQYVYIIEELLYKSNEFHNKKPYYETLVNQIIELEQSDDLIIGLSYTVQRLVVDHLHVVGDIYDRGPKPDKIMDTLINYHSVDIQWGNHDVLWIGAYAGSKVCLANLLRICARYDNLDIIEDAYGINLRPLLTLAEKYYDAENPAFKPKKRPDKDVSLTKREESQITKIHQAIAMIQFKLEMPIIKRRPSFEMEERLVLEKIDYDNNEITIYNKTYPLKDTCFQTVNPNNPAELLAEEKEVMDKLLLSFQQSEKLRRHMSFLMRKGKLYLPYNGNLLIHGCIPVDENGEMESFEIEGERLSGRELLDVFEYHVRRAFDHKESTEDISTDLVWYLWTGKYSSLFGKRAMTTFERYFIEDKASHKEEKNPYYYLREDVDMIRKMLKDFGLNPDEGRIINGHTPVKEIDGEDPIKANGKMLVIDGGFSKAYQSTTGIAGYTLLYNSFGMQLVAHKEFNRKEKVLSMGADELSVKRVVDEELQRKKIRDTNIGKQLQDQIDILKILMHDRYLT

SEQ ID NO: 4323 - protein, 332 aa, Staphylococcus epidermidis
FLMTKIMFFGTRAYEKDMALRWGKKNNIDVTTSTELLSVDTVDQLKDYDGVTTMQFGKLEPEVYPKLESYGIKQIAQRTAGFDMYDLELAKKHEIIISNIPSYSPETIAEYSVSIALQLVRKFPTIEKRVQAHNFTWASPIMSRPVKNMTVAIIGTGRIGAATGKIYAGFGARVVGYDAYPNHSLSFLEYKETVEDAIKDADIISLHVPANKDSFHLFDNNMFKNVKKGAVLVNAARGAVINTPDLIEAVNNGTLSGAAIDTYENEANYFTFDCSNQTIDDPILLDLIRNENILVTPHIAFFSDEAVQNLVEGGLNAALSVINTGTCDTRLN

SEQ ID NO: 4324 - protein, 70 aa, Staphylococcus epidermidis
ASMTYISLSQKIRNANILNYQKIFTNLKIISILITILLILIYFKTIAVDSFIASYVDSYIKKSHYWEGTQ

SEQ ID NO: 4325 - protein, 353 aa, Staphylococcus epidermidis
LMSTIKNIDGPKDFVFRVLSGVAIGIVAGLVPNAILGEIFKYFMQYHPIFKTLLGVVQAIQFTVPALIGALIAMKFNMTPLAIAVVASASYVGSGAAQFKQGTWVIAGIGDLINTMLTASIAVLLILLIKKRVGSMALIVFPTVVGGLAATIGVFTLPYVRLITTGIGNMVNSFTELQPVFMSMLISMVFSFIIISPLSTVAIAIAIGLSGIAAGSASIGIAATEAVLLIGTSKVNHVGIPLSIFFGGVKMMMPNMVKYPVIMIPIFLTAAISGIASGIIGISGTKESAGFGFIGMVGPINAFKFMHVDSAWLSLLLIVIAFFVVPFLVAWILDLILRRLIHLYENDIFKFMG

SEQ ID NO: 4326 - protein, 65 aa, Staphylococcus epidermidis
PGTTNPAGLIPNFSANIKLSTTPTNKEKYNSEPIILFYPFYEFRYSTTRAVDVSYTKYKCILSFM

SEQ ID NO: 4327 - protein, 160 aa, Staphylococcus epidermidis
EKATTMKKVISLLVVLVISAVSLSACGKERTKTYEGEVNGKQVITSLTYKDDEVLKQSTIATIKYDDLGIDKDEAKQMFKNDEQAFKGIDGVTYKADFKDRKAIEHIDIDYKDADIDQLKKNLGFISSDAKKGDHVSVDRVVKQLKRNGLKDKSKMNEDN

SEQ ID NO: 4328 - protein, 330 aa, Staphylococcus epidermidis
HSYLCNFIMKEFVKMKKFGKKVVLVGDGSVGSSYAFAMVTQGIADEFVIIDIAKDKVEADVKDLNHGALYSSSPVTVKAGEYEDCKDADLVVITAGAPQKPGETRLQLVEKNTKIMKSIVTSVMDSGFDGFFLIAANPVDILTRYVKEVTGLPAERVIGSGTVLDSARFRYLISKELGVTSSSVHASIIGEHGDSELAVWSQANVGGISVYDTLKEETGSDAKANEIYINTRDAAYDIIQAKGSTYYGIALALLRISKALLNNENSILTVSSQLNGQYGFNDVYLGLPTLINQNGAVKIYETPLNDNELQLLEKSVKTLEDTYDSIKHLV

SEQ ID NO: 4329 - protein, 192 aa, Staphylococcus epidermidis
NGGAMMDYNNNDSQYIEEAKDLVINSIGETMDLYGINRSVGNLYGIMVFEGSMTLDEMRQQLQMSKPSMSTGVKKLQEYDIVKQQFTRGSRKQHFIAEKDFFTFFRNFFTKKWEREIDTNMEAIEDAENIIHPLLEKNDIDEEVKKQAINVKAQLDHSKIYYKWLAQLSEALESGEIFNYFPIPDEQHHHDQ

SEQ ID NO: 4330 - protein, 146 aa, Staphylococcus epidermidis
FYLAGAISDKILNTGQSRFVARGVIAIAGFVVFSISIFLAVHTDNLYVTIFWLSLCLGGVRISMGMSWAAATDLGRNFSGTVSGWMNLWGNVGALISPLLAGIVVDHLGWSMTLQLLIVPAIIAAILWFFVKPDKPLIVSEEHVNK

SEQ ID NO: 4331 - protein, 95 aa, Staphylococcus epidermidis
TSMAAEIKQGDHKFYVGNDENNPKAVITFKEVDNNEIDIDHTGVSDELGGQGLGKKLVNRVVEHARENNLKIIASCPFAKNVLEKDDHAQDVYLG

SEQ ID NO: 4332 - protein, 287 aa, Staphylococcus epidermidis
MKEAKMKKQQNKVHMINISLCLIGTLLIAIAVNSFVIPGNLGEGGSIGLSLILNYTLGISPALSSFIINAILIIVGWKFLSRTTAIYTAITITASSIFLDLTHTFGLGIHDNFINSIFAGLMLGIGSGLVITAHSTLGGTSVIARIISKYSEMKTSQALLILDAIIVLSFIVVLPITNVLYTIVMLFIVEKSMSFVVEGFNPKKAVTVISKYNKEISADIYEMTGRGATLLSGKGAYQKSDTEVLYAVVSQNQVGAIKKIVNQYDENAFLVIHDVRDVLGNGFINIK

SEQ ID NO: 4333 - protein, 181 aa, Staphylococcus epidermidis
YTHLRSWRNMYQSMYDSPVGLLQLITNDGISLSHVLYPNQHLKGIKTNDTLDVFKDTKAWLREYFKGNYPEIKVPLAPKGTDFQQKVWNELQTIRYRELKTYGEIAKTVGRAMNKPAMSAQAVGGAVGSNPISILIPCHRVVGKDGNLTGYGGTLDNKIKLLKLEEIDMTHLYRPKKTTKP

SEQ ID NO: 4334 - protein, 118 aa, Staphylococcus epidermidis
QLFYRDNLKVGIKLICSNCGAHLEKDDKFCVNCGQSVFDNPKTKTEHNFNSQDRQCPKCHKVVNVDDKFCINCGHSLQQTLSNSNDNIASHTYSNTKPEIENETADHIRLTEEAQASI

SEQ ID NO: 4335 - protein, 70 aa, Staphylococcus epidermidis
SIIYIKDEFVMFILVNTILFIAIFGYTAMTLVKFFKRSKEGDCGGCKSNCKCDTNTSSHKNKLNIPHIKS

SEQ ID NO: 4336 - protein, 158 aa, Staphylococcus epidermidis
MSIYDIEVENYDGSTYLLKRYKGKVLIIVNTATNCTLNDQFNKLEMLYKKYHKYGLEILSFPCNDFNNQEPGLIKDIYRVYKYKFGITFPIHAKINVNGEHEHPLYTLLKCKQPGLFGSQIKWNFTKFVVDQQGNIVKRFLPCDNPNQMEKLIRQLLK

SEQ ID NO: 4337 - protein, 403 aa, Staphylococcus epidermidis
IKVYNNLEERIKMNQTLVQHLREKEQRMKEIRRYLHENPELSFEENETSKYIANFYKDKDCLVETNVGPNGIKVTIAGKHPGKTIAIRADFDALPIKEETELPYASKNEGVMHACGHDAHTAYMLILGETLIEMKDQLRGNVVIIHQPAEEMPPGGAKGMIDDGVLEGVDHVLGAHVMSMMETGKIYYREGFVQTGRAYFRLVVKGQGGHGSSPHTSNDAIVAGAHFVTTAQTIVSRRLNPFETGVVTIGSFDGKGQFNVIKDTITIEGDVRALTDDTRDNIQNEMTRLVRGLEEMFGVICDFEFKKDYPALYNDPEFTSYVATTLKNAKLDDIKAIDICEPQPPSEDFAFYALERPSTFIYSGAAPEDGPMYPHHHPKFNINETSMLVVAEAVGTIVLDYLK

SEQ ID NO: 4338 - protein, 431 aa, Staphylococcus epidermidis
SCNYIDKVKVLQFMKGGIMMSVLSNEERVEILSDIVSIKTVNSNELEVAQYFERLFSQYGIRSYIDIVADGRANLIATVGSSHPVIGISGHMDVVSEGNHDDWTYDPFTLTEDQGYLYGRGAADMKSGLAALAIALIEIKESGKLTQGTIKFMATVGEEMEQSGSQQLFEKGYADDLDALLIAEPSFPSLVYAHKGSMDFRIKSKGRASHSSIPFLGQNAIKPLLEFIQNINQEYEKIMQTVKGESLDFSNMINKLENQLPNHITKEKAQELIQGLVMTNSIVQGGTQVNSVPDFATAEFNVRTIPEYNNNKVKALFNKYVEQANHNGASLTQELYLDLEPVVTTGQNRLVELGFDIAKSHFSNERDLIITPTVAVTDASNLLKGKDENFPFLMFGPGNGPHQINECVEKVNYLEFVEYYIEFITSYLNEK

SEQ ID NO: 4339 - protein, 290 aa, Staphylococcus epidermidis
KVNLLKFHNKIKGYTQNRQPGIEADMEPKPIAELEEYKAAGKLENKVALITGGDSGIGRAIAILYAKEGANVAIGYYDEHQDAEDTVNRLQEMGVKAKAYAHDLKDEKQSQKLIKDVINDFGSLNILVNNGGVQFPRDHFEDITPQQVKETFMTNIFGMMFLSQAAVPYLSEGDTIINTTSVTAYKGSGHLIDYSATKGAIVSFTRSLATTLMEKGIRVNAVAPGPIYSPLIPATFDEEKVEHQGDETPMGRRGQPAELAPSYVFLATHADSSYITGQVIHVNGGDFITS

SEQ ID NO: 4340 - protein, 65 aa, Staphylococcus epidermidis
QQFYGSSLNQTNLLLLVKNTLINNIFQTHAMTFISLRVFILLLCGIEHGSDKRIVFFISYKLLNL

SEQ ID NO: 4341 - protein, 695 aa, Staphylococcus epidermidis
RNLFNHAYLVKKLNSKIKIVGEIHGPLEYINENIDLALDCIDCVRVSTARIKNEFIAKYDYHRVFNQYVNAQHIDLKSEPINTKRNFLIKARFEDEVKDISYIIKLFNYIIKNQIVDDAQLYLIGYGPSEMLYKNLINYYHLNEYIHINEKEPQSYIYVSSSPYETLGYSILETIAQGNKALVYYGDDNVLKDIYAPYEAIRFLTKDMIKDSKIIKDFLNYKYSHFDRQKYYRQLESTFKCINYGQEFLNNVETFSSSQHVKVKKIHRHLGSEKQIDIASRLKESRWMNLIRKNKYLFNKCKTYYEKRTHMSYIKNLNQIPVDDDSIFIESFHGKNFSGDPKYIALAIKRQYDHKKIYVSSTNSLVDMEIKRYGFTPVRFGSEKYIKTFRKCKYVFINGNSWDKVYKSSDQIFVQTWHGFPLKKMVNDLNEQHERQQQLEAFIPRMKKWDYILTSSDINTTLLESAFMLNKNPNLKVLEYGAPKNEYLINNNNLQERQQLQLKYMYKIDDDKKYILYCPTWRGNQRKEVTQINLKDLLKYLPENYEIIVKLHPNESHLRTRYNQIDNRIHCYFNELVDIQELYILSECMITDYSSTIFDYIHLNKPVFILQEDEQQYKQSVGFYFDLFEVGDFLKASLNEHMLAKQICSTDYINYSKVVHRLMKQDSSKSSEKLMAEILGEPEYPSSSNCKQQIS

SEQ ID NO: 4342 - protein, 626 aa, Staphylococcus epidermidis
YTLYIAKGDEMTTLETSLTRLITKDPTILNENANKDSNTFSTMRDLTAGTVSKSYALDHLLPKHVAHAHQSGDIHFHDLDYHPFQPLTNCCLIDAKDMLENGFEIGNANVTTLQSIQTASAQLVQIIANVSSSQYGGCTVDRVDELLSKYAQMNAQHHREVANDFVQPDKIENYVDTQVTKDIGDAIESLEYEINTLYTSNGQTPFVTLGFGLGTDQLSRKIQQAILHTRIKGLGKDRVTAIFPKLVFSIKKGINFGPEDPNYDIKQLALECSTKRMYPDILNYDKLVELLGDFKAPMGCRSFLPSWKNDEGQLENNGRCNLGVVTLNVPRIAIEADGNMQQFWDIFEKRMQLLHDALVYRIERLQDAIPDNAPILYKSGAFKNKLTSEDTVDSLFTKQRATISMGYIGLYEAATLFYGPNWEHNPEAKTFTLDILREMKRYQVEWTKQYDIWFSIYSTPSESLTDRFCRLDKEKFGSIPDVTDKGYYQNSFHYDVRKDVTPFEKLDFEKDYPYYASGGFIHYCEYPKLNHNLKALEAVWDYAYDKVGYLGTNIPIDHCYRCGYDGDFETTANGYRCPHCGNTDPKTVDVVKRTCGYLGNPVQRPVIEGRQKEICARVKHMKALRS

SEQ ID NO: 4343 - protein, 560 aa, Staphylococcus epidermidis
YNVYFNFNKEEFVNMKNNWIDVLDESLVKDFYNNQTSEEQQEGLNTTLSFGTAGIRGKFGLGEGRLNKFTVSKVALGFAHYLTSSIAHPVVVIHYDTRHLSPEFAQIIANILASLDIKVYLADTYRTTPDLSFAVRYLQADAGVMITASHNPKDYNGIKVYGEDGAQLSTDDSARLSTYIDKLGHPLHINLPSLTTEQQSLIHSVPSEVREDYFKNVQDLVGTIPQSDLKVVFTSLHGTSVPVVPDILSSLNFNQFELVASQCEPDSDFSSVASANPEDHKAFDQSIELANHIDADLLIGTDPDADRLGIVERDAEGNIHYYNGNQIGALLLNYRIKQTEGLSNRIMFQSIVSGGLAKSLAQYHNVNFKEVLTGFKYIAAEIRHLSPEQNFIFGYEESYGFLARPFVRDKDAIQIVPLMIKYAAELKNKGRMLKDELEDITRNVGNFNDKLFSHTFEGTQGKAKIENIMTQFRSETPSEMCGLKVIAIEDFETGKKTDLQNDEVSDITLPKANVIKIYFNEGFIALRPSGTEPKIKLYVSLSCDHFDVVAQKMNDAIFNS

SEQ ID NO: 4344 - protein, 266 aa, Staphylococcus epidermidis
YWTYHFKEKGKMVIMDDLKQNQSSNEKPKGNKIINILIFIGMILLIQIPIGVSLIALPFSVKFSKLTSIALSMLITGTALLIIWLVRNYYLSHTYERQYQSMRGKDIFINIGFLVLSMVFSILSSVLMVIFTGNDTTANEKEINESLDLLLQKDHLPHISIVATVVLMICIIGPYLEELLFRGIFKETLFMKYRFWLPFIISSIIFSSQHLSTNIFSYAIYFLMGCVLYLAYNRRRNIKDSMMVHMLNNSVSTLPVFVGYLWIYFR

SEQ ID NO: 4345 - protein, 336 aa, Staphylococcus epidermidis
FQKYTYYTNIDMKGTVSRMKNLKFLVVLVLSVVIFAAACGNSSSLDNNKSSDSGSDSKSGSYTPKELTVQFVPSQNADTLEAKAKPLEKLLSDKLGIPVKVSVSTNYNTIVEAMKSKKVDVGFLPPTAYTLAHDQKAADLLLKAERYDVNEDGSPSKKLVDDYKSEILVKKDSGINNLKDLKGKKIALQDVTSTAGYTFPLVTLKKEAGIDATKDMKIVNVKGHDQAVISLLNGDVDAAAVFNDARTVVKKDQPNVFKDTKILKLTKPIPNDTISVRPDMDKKFQDKLKKAFKEISKTKKGHKIISEVYSHEGYVDTKDSDFDIVRQYEKAVHDMK

SEQ ID NO: 4346 - protein, 444 aa, Staphylococcus epidermidis
NMKYCSNCGQPLREGVKVCTNCGTPVRNDGPNYKHSEQRYSHQQPRSNKSNKKTWLIVTIVLAIIIALVVIFTIAKNQMSPEKQATHIAHAIKKDDAKSLSKQLTSNDHRLNEEEARAYLKYIKAESDLKHVADKVEENTKDIKNNHYNNLSVDANDNNILNISKDGKKYVFFDNYQFNVPQKTITIVSSDSGEITYEFNGDKHHISVEEDDDKELGTFPIGDYNLKASKDMEGKNFKGAITIDMSESDSIAYESFKQKRFNVDTEGGYILDNVKIYANGKEIGDGFSSETYGPYDPDEEVIVHAEGSYEGKTFKSNSVNVASASEKDGGVTDVTVKFDEEAIDQYVDKKLDEKYDDSDDESDNDSSSGEVTRENVIDKVESYEGHTLDTDTYTYKEPEKTGDGKWGFSFLDKDGDLAGSYTVDIDDGYVTEYDEDGEEVGSGY

SEQ ID NO: 4347 - protein, 514 aa, Staphylococcus epidermidis
NMKYMIGVDMGTTSTKAVLYDENGKFIMKHNIGYDLHTPNVDVSEENPDEIFDAVLMTVKYIVRESGIAKEDIKFISLSAQMHSLIAMNEDNQRLTENITWADNRANDYADLIEKSYGGFELYQRTGTPIHPMSPLSKIFWMRHEEPKIFKQTAMFADLKTYVLFQLYERFVIDYSLGSATGMMNLEQLDWDNKALELLGIERNQLPQLVPTTHVLTGMKKRYATLMGIDEQTPVIVGASDGVLSNLGVNSYQKGEVAVTIGTSGAIRTVINQPKTDEKGRIFCYILDKDQYVIGGPVNNGGVVLRWLRDEILASEVETAKRLGVDPYDVLTQIASRVKPGAEGLIFHPYLAGERAPLWNADARGSFFGLTLSHKKEHMIRAALEGVLYNLYTVYLALIEVMNETPTTIKATGGFAKSEIWRQMMADIFDTDLIVPESYESSCLGACVLGMKALGEIDDFSVIKDMVGTTHAHEPNQETVAIYQQLVTIFINISRSMTENYSDIANFQREHLSD

SEQ ID NO: 4348 - protein, 518 aa, Staphylococcus epidermidis
GRRYGHSFPINKEVLDMTIYNINFGIGWASSGVEYAQVYRAKLLRQLPYPTKFIFLDFIQSENIQTLTSNIGFKDDEVIWLYQYFTDVKIAPTTYTVDDLISELGNEVTRKEQNGKVLRLYLNNQQTFVTCYLKNANEHYVDRAEFVVNGMLIRKDFYSYVRTFSEYYAPFDNKAKIYMRQFYNENGSIAYREYIDEDEHVFVFDDARLYSKQALVAYFIRQLRLNSEDIIIIDRATDVGQAILENKGSSKVGVVVHAEHFSEGATDGTHILWNNYYEYQFENAQHIDFFITATDLQRQTLSEQFKQYKNDCPRIRTIPVGSIESLQYPEKERKPYSIMTASRLANEKHVDWIVEAVIKAKHQLPQLSFDIYGQGEEQEKIKNIITKHRAEDYIQIKGHRNLRTIYQQYELFIAASQSEGFGLTLMEAVGSGLGMIGFDVNYGSPTFIRHHQNGYLIPIDFEQASTDDITTQIAHMIIRYFEDGPIRAHEVSYDIAESFKTSHIVDLWRQLIEEVLYD

SEQ ID NO: 4349 - protein, 512 aa, Staphylococcus epidermidis
KLTLSQSLSSILDLSYILGGNLFMKFMNKMGKTTLASSIVAASVLSTVNVSYASGSSEQSAQTKQTQNDAIAFGNTKNPKNVIFMVGDGMGPSFNTAYRYYKNKPGAKKMTPTAFDKYLKGTNRTYSNDPKENVTDSAAGGTAFSTGHKTYNGAISVDTNKKPIKSVLEQAKEQGKSTGLVTTAELTDATPAVYAAHIDSRDKKDEIAQQFYNDKINGKHKVDVMLGGGAKYFGKENKNLAKKFKKDGYDIVSNKDELNQSQSKQVLGTFSEKDMPLQIDAPQSNPLLVDMQNSALNKLSKNNKGFFLMVEGASIDKAAHPNDITGVMSEMSGFETAFDNAINYAKTHKDTLVVATADHSTGGLSTAKGKDYKWNPEAIHKMKHSGMYMTKQIADGKDPEKVIKDGYGIDFPNKQLDKVKKAADELHKLQKEGKDDKDEKVVEQTTKLQNAIQKPINDASHTGWTTNGHTGVDVNTYAYGPGSNKFKGNMENTQSAKNLFDFFGDNVTSNQN

SEQ ID NO: 4350 - protein, 227 aa, Staphylococcus epidermidis
NVTYGYPKKWKENMTSGQVIAAELRLGIVSGEIESHIQLSENQVAQQFNVSRSPVRDAFKLLQTDQLIQLERMGAQVLPFGDQEKKEMYDLRLMLESFAFSKLSGTDTQHIVKEMKKQLEMMKVAVQFEDAEAFTQHDFEFHEVMIQATNHQYLKVFWNHLKPVMESLILISMRQRMTNDPKDFERIHSNHQVFIDAVENDDASILRKAFHLNFDDVGENIEAFWLR

SEQ ID NO: 4351 - protein, 73 aa, Staphylococcus epidermidis
YKDLLRHILNSAINFQYTKHLRQISMSQAQLFKYKHLLEKHTSIYVLVILIFKLWSENYWCTLMKFTCICTIH

SEQ ID NO: 4352 - protein, 944 aa, Staphylococcus epidermidis
MHYLMLMYSLSLKCLYLLTHLRMYLHCPSRSHLLTLIHFLMSMCSLSLKDSYFSSHLMTYLYCLRHSHSLMLMYLSILKRSYLSSHLTMYLHCPSRSHLLMLTHCLMSTYSLNLKDSYLSIHLMTYLHYSSHSHSLMLTHFLTLTRLLNLKRLCLLIHLMTYLHCPSRSHLLMQMHCLMSMYLLSLKRLYLLSHSMMCLYCLTHSHSLMWMHYLMWMCLLILNHLCLLIHLMTYLHCPSHSHSLMLMHCLMSMYSLNLKRSYLMIHLWMCLYCLTHSHSLMLMHCLMLMYLLSLKCLYLLSHSTMYLLFPSRSHLLMQMHYRMLMYLLSLKRLYLMSHLTMCWHCLSHSHSLMLMHCLMSMYSLNLKDSYLSSHLRMYLLFPSRSHLLTLMHCLMSMYSLNLKDSYLSSHLTMYLHCLTHSHSLMWTHCRMSTRLLNLKRLCLSTRLMTYFHLLSHSHSLTLMHCRMSTYSLNLKRSYLMIHLWMYLHFPSRSHSLMLMHCRMSTRLLNLKRLCLSTRLMTYFHLLSHSHSLTLMHFLTLTYLLSPKDLCLSIHLMTYLYCLTHSHSLTLMHCRMSTYSLNLKCLYLMIHLTMCWHCLTHSHSLMWMHFLTLTRLLNLKRLCLMIHSTMYFHLLSHSRLLTLMHCRMSTHSLSLKDSYLSIHLMTYLYCLTHSHSLTLMHCRMSTHSLSLKDSYLSIHLMTYFYCLIHSRSLTLMHCRMSTYSLNLKRLYLSIHLMTYLHCLTHSHSLMWTHCRMSMYLLNLKRLCLSIYLMTYLRYWSHLRSLTLMRYQTSTYSLILIIVYLCLLIRSLLLMRYQTSMCSLSLKCLYLLSHSHLLMLTHFLTLTRLLNLKRLCLSIHLMTYFYSLTHSFLLTLMHYQMSTYSLILIIVYLCLLIRSLGLTYYSTSTHLTTLRDSYLLIMIDSLLHYHLAMYYYLYLLKHYLLC

SEQ ID NO: 4353 - protein, 398 aa, Staphylococcus epidermidis
KGHLVVMTVARTTTFILSVFIVGMVEMMVAGIMNLMSQDLHVSEAVVGQLVTLYALTFAICGPLLVKLTHRFSSRSVLLWTLIVFIFGNGMIAIAPHFGIIVVGRILSSAAASLIIVKVLALTAMLTSAKNRGKMIGIVYTGFSGANVFGVPIGTVIGDWVGWRFTFLFIIIVSVFVGVLMLIYLPKEDELSHPNQTPRSSSIESQTGSSVIRPREVFKYLMITFLVLVANSVTFVFINPLILSNGHEMSFVSLALLVNGVAGVIGTSLGGVLSDKFTSKRWLIISISIFIIMMIILNLLLPGTGLLLVGLFMWNLMQWSTNPAIQSGIIEHVEGDTSQVMSWNMSSLNAGIGVGGIVGGLVMTHLSVEYVTYTSALIGLISLIIVFTLKNRHYAKNL

SEQ ID NO: 4354 - protein, 65 aa, Staphylococcus epidermidis
TFIHIVNIDENINDMNKRSSINCNNYFLSKLKSRCKVAISHLPHSRTLQRHVIYKLKHFRNNFLF

SEQ ID NO: 4355 - protein, 136 aa, Staphylococcus epidermidis
NHIHYQEAPNLTKVEYGDHYERRFMKPKKLKANIEYTTPHGHVYRTDHKGRIKEVYADDLSLLDGGRNSYAQRTVGREYRLPDDDGGHLIARGFGGSKDIDNLVPQSKYINRSFKENGEWYNMKKEWQKAIKKGEK

SEQ ID NO: 4356 - protein, 675 aa, Staphylococcus epidermidis
CTTHNIRGVVIMTQSYCILGNPNVGKTSLFNALTGSYEYIGNWSGVTVEKKVGKLKDNVGDLVDLPGIYDLSPISKDETVVTDYLMSTSFTGMINIIDACQLKRNLNLTIQLMELNKPMIIGLNMIDVATQRGIKINYQALMRKLKVPVFPIVARKAKGTHSLLGELNYLEPHQRRAFKINYGTEIETAIQQICSIIKQDNMYPTERLRFIAIQYLIDNVQIYQELDAMILEQLEPIKRKLSNATEQSTRQRIEAVRNDYINQLLEDIVEYPEEDKQFFTSKVDRLLLNRYLGIPIFLGIMWLIFQTTFTWIGTPLSDQLDAFISGPLSEWIKSVMNTLHITSFLQDLITDGIIAGVGSVLVFVPQIVVLFFFISLLEDSGYMARIAVLMDKTMESIGLSGKSFIPMIIGFGCNVPSIMAARSIENEKERLITILVAPFMSCSARLPVYALFVGAFFSAHQSLVVLSLYILGIVVALLVSTLLNKLILKDNQSVFIVELPTYRVPSFKTLWRSTWEKAKGFVKKAGTFIFGGSVVIWTLTYIGPHGVNVPINQSFMHMIGQGFANLIAPLGFGSWQAGATLIPGFLAKEVIISSMAILYSSSESGLTQVIQQQFTPLSAYAFMIFILLYVPCISTVATIRKETSSWKWTLLAVVYPIATAYILTFVFYQVSQLFI

SEQ ID NO: 4357 - protein, 360 aa, Staphylococcus epidermidis
LEHHEIHSLMLLNLIATYKMKGAHPMKNIKKPFDLKGKSLLKEYDLTGEEFEGLIDFAMTLKKYKQQGTPHRYLEGKNIALLFEKTSTRTRAAFTVASIDLGAHPEFLGKNDIQLGKKESVEDTAKVLGRMFDGIEFRGFSQKTVEQLAEFSGVPVWNGLTDDWHPTQMLADYMTIKENFGYLKGINLTYVGNGRNNVAHSLMVAGAMLGVNVRICTPSSLTPRDVYFNIAKDQASNYGGSVKMTDNIHTAVKDADVIYTDVWVSMGEESEFETRIHLLKDYQVNRKMLNLTGKVDTIFLHCLPAFHDTQTEYGQNIFEKYGLTEMEVTDEIFRSEHSRVFDQAENRMHTIKAVMAATLG

SEQ ID NO: 4358 - protein, 158 aa, Staphylococcus epidermidis
EVDHSMKKSKRQDLVTMIVKQNHIYKKADIIDYIDDHFGVRYSMTTIARDLRELHIYRLPVKANQYEYKLLTQQSQLDSRVRLNDYIETEIINTMIKESYILIKTTPGFAQSINYYIDQLQLKEIIGTISGNDTIMILTHSQSIAEYVYYKIFNHNYS

SEQ ID NO: 4359 - protein, 98 aa, Staphylococcus epidermidis
GMSQYPFYRRMFIIIKKCTLIYNSIKELYPMRKILKGIILSLIIIGLIKTFNEYDIIHCANHYFEQIKSGKIIEDIKIDHFNNYHNINFEDLNPSDFF

SEQ ID NO: 4360 - protein, 243 aa, Staphylococcus epidermidis
KRGHIVIEANQILAKMKNQKINYDKVLRKIISQWERDGERPKILLHSCCAPCSTYTLEFLTQYADIAIYFANPNIHPKSEYLRRAKVQEQFVNDFNNKTGANVKYIEAEYEPHKFMKMAKDKGLTEEPEGGLRCTACFEMRLEIVAKAALEHGYDYFGSAITLSPKKNAQLINELGMDVQNIYNVKYLPSDFKKNKGYERSIEMCNDYNIFRQCYCGCVFAAMKQGIDFKQINKDAQAFLQQF

SEQ ID NO: 4361 - protein, 660 aa, Staphylococcus epidermidis
GSTHKMKKNKFLVYLLSTALITPTFATQTAFAEDSSNKNTNSDKMEQHQSQKETSKQSEKDEFNNDDSKHDSDDKKSTSDSKDKDSNKPLSADSTHRNYKMKDDNLVDQLYDNFKSQSVDFSKYWEPNKYEDSFSLTSLIQNLFDFDSDITDYEQPQKTSHSSNDEKDQVDQADQAKQPSQHQEPSQSSAKQDQESSNDEKEKTTNHQADSDVSDLLGEMDKEDQEGEDVDTNKNQSSSEQQQTQANDDSSEHNKKYSSITDSALDSILDEYSQDAKKTEKDYNKSKNTSHTKTSQSDNADKNPQLPTDDELKHQSKPAQSFEDDIKRSNTRSTSLFQQLPELDNGDLSSDSFNVVDSQDTRDFIQSIAKDAHQIGKDQDIYASVMIAQAILESDSGKSSLAQSPNHNLFGIKGDYKGQSVTFNTLEADSSNHMFSIQAGFRKYPSTKQSLEDYADLIKHGIDGNPSIYKPTWKSEALSYKDATSHLSRSYATDPNYSKKLNSIIKHYHLTSFDKEKMPNMKKYNKSIGTDVSGNDFKPFTETSGTSPYPHGQCTWYVYHRMNQFDASISGDLGDAHNWNNRAESEGYTVTHTPKNHTAVVFEAGQLGADTQYGHVAFVEKVNDDGSIVISESNVKGLGVISFRTIDAEDAQDLDYIKGK

SEQ ID NO: 4362 - protein, 227 aa, Staphylococcus epidermidis
HKGLRRRKRQFLYLFNRNCLFYNCIKKTMRYAYGSEKVLPLSKKTSHHARIYIGQPTKIFNTRRCFFMSSDTNSLAHTKWNCKYHIVFAPKYRRQVIYGKIKRDIGVILRQLCERKGVEIIEAEASKNHIHMLVSIPPKLGVSSFVGYLKGKSSLMIFDRHANLKYRYGNRKFWCKGFYVDTVGRNKKVIENYIRNQLQEEIVADQISMEEYLDPFTGEEIKKRRKK

SEQ ID NO: 4363 - protein, 251 aa, Staphylococcus epidermidis
ITKQTNFKLYLEDLYIMKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 4364 - protein, 75 aa, Staphylococcus epidermidis
LYFKYIGDRHPLKNTSYIFKMRASGIFLYTNKPINKINIIPDTEIIVSNNDHVKNVSLTVSPKYSLNIQNPASLT

SEQ ID NO: 4365 - protein, 366 aa, Staphylococcus epidermidis
RLINGGMTMPESKALLKSLTDVNGISGHEMQVKSLMKDYLTPVSDDIVEDQLGGIFGKKNATHGTKSLMISGHLDEIGFIVTQIDEQGYIYFTPIGGWWNQVMLSQKVTITTESGKEIRGIIGSKPPHALSSEERKKPVDIKNMYIDIGVRNKEEAKEAGIELGNMITPYSEFESLANDKYLTAKAFDNRYGCALAVEVLQQLKDENIDINLYAGATVQEEVGLRGAKVAANLIKPDLAIAVDVGVAYDVPGMTSEKNEGKLGDGPLAILMDATSIAHDGLRKHIKDVAEHHNIPVQWATTPGGGTDAGSIHVANEGIPTITIGVPLRYMHSNVSVLNIDDYTNSVRLITEIVRSLNDDSYQALMW

SEQ ID NO: 4366 - protein, 62 aa, Staphylococcus epidermidis
VKIKVTNLILRCIMRKLISTIIVSTLLIGGCSTVHKEAKHTSQSIPEEVPASQYKGQGFHNQ

SEQ ID NO: 4367 - protein, 293 aa, Staphylococcus epidermidis
MEIKQIKYFVEVVRQGGMTQASEHLYIAQSTISKAIKNIENEYDITLFDRSQKQIKLTDIGQTFYDNSLEFLALFEKLSLEMNDIVNVQKGHIKIGLSPMMNVQMFTNALNQFHRLYPNVTYEVIEGGGKIVENLTSNDDVDIGITTLPVDHTEFHSTSLYNEELLLVVSNDHHLAHLNKVDMADLKDEEFVLFHDDYYLKDQIIENCKRLGYYPKTVANISQISFIANMIQQGIGISIVPESLVNLMGNNVTSIQLENVELSWHLGVIWRKDAYLNHVTRKWIEFISEMKPT

SEQ ID NO: 4368 - protein, 90 aa, Staphylococcus epidermidis
MKINIFGYNIFAKGGTSRSNINLVKSLLEIGHEVHYFNYQDYNKSDITKLIIYEGLSTKHLHIHQFNSGKELAHGDLLIITRETFLIMHI

SEQ ID NO: 4369 - protein, 303 aa, Staphylococcus epidermidis
RGINMFDSIRETIDYSVENNISFADMMINDEMEREGKSREEVRDLMRQNLNVMREAVEKGTTGDGVESVTGYTGHDAAKLRDYNENNHALSGHEMIDAVKGAVATNEVNAAMGIICATPTAGSSGTIPGVIFKLEKTHNITEDQMIDFLFTSALFGRVVANNASVAGATGGCQAEVGSASAMAAAAAVSIFNGSPEQSGHAMALAISNLLGLVCDPVAGLVEIPCVMRNAIGSGNALISADLALAGVESQIPVDEVIGAMDRVGRNLPASLRETGLGGLAGTPTGEEIKRKIFGEADNMVKNK

SEQ ID NO: 4370 - protein, 100 aa, Staphylococcus epidermidis
ELTKMIIINAKLKIDANKREDYLKLMKELVINSRKEDGNLFYHHYEDVTEKNVFVVVENYKDEQAVQAHNQSDHFKVFSDNISQYLIEEPQIDVSQPIQL

SEQ ID NO: 4371 - protein, 313 aa, Staphylococcus epidermidis
LFYKVVYFVELNILECEGVFELKKLAVICAFTILILAGCGLGDSDNNGSSTINDDQQSGYKSNRDSKSSISRNQTEDNQQDTQQDTHSNRYYAQVWLTALDSYRGESDLPFDDLEIVHQNISNKVLDPYHPDESAKLPEGTELLTASVTAAGSVYYKSNGDGTITIYSVPSHFQGSWRDADYSKRESQRIIDDARTVKLYNASESEINKISQMMRTEFSVGDNLTDEDDTSESEDQSSSSDEVTVTRSNVIDIVEDYEGHQLDTDTYIYKEPEKDSDGSWGFSFTDKEGHLEGSYIIDKDGEVTKYDEDGEPE

SEQ ID NO: 4372 - protein, 79 aa, Staphylococcus epidermidis
IPYKGVYIFRHFFNSYILKLIYSNSMYFSSLLFRHLLQNNIIEIKKSLDIHLPCVQTLNHAHSILLIQSSSYLYLFKPF

SEQ ID NO: 4373 - protein, 228 aa, Staphylococcus epidermidis
CRYKDVFKLLLKVEHLTYKVDNRTILDDINLNINKGDTIAIVGPSGSGKSTLLKQLNHLISPTSGDLYLNDQSYFNYKPEEIRTRVSYLMQQSELIGYTIEDNMKFPAEARSEAFDRDKAKQLISQVGLGNYQLDAQIEHMSGGEQQRITIARQLMYEPEVLLLDEATSALDTHNKKKIEEIIFKLADKGIAILWITHSDDQSMRHFKRRITITDGKISSDEELNGNE

SEQ ID NO: 4374 - protein, 105 aa, Staphylococcus epidermidis
ITYKSLRMLLFIGGPIMDKINKEDTDTKKDSNNNYKHQNDHIDRQGLNGYQKTDLDLEIERELQEMMENGESNKETKSKHFKILSFVSMIVIVVIAIIRFIQKTI

SEQ ID NO: 4375 - protein, 98 aa, Staphylococcus epidermidis
QLNKAYKNNLMAKTNKSGTRIFYVPDLLYVYTDSYEMSPTQRISEEIPRTKQVGVGAPTERISEEIPRTKQVGVGEKTGDNEFYPSLAFILIRGILQS

SEQ ID NO: 4376 - protein, 270 aa, Staphylococcus epidermidis
GWNKVTTPTTHKYNRYLNKRMSLKTSFSIILITGLIIWSFIYTGFSIGDLMIGLPQIGVFFKQMIPPDWGYLDHITQPMLDTIRMAIVGTFLGSIVSIPIALLCASNIVQTKWIAIPSRFVLNIVRTIPDLLLAAVFVAIFGIGQIPGVLALFVLTICIIGKLLYESLETIDPGPMEAMTAVGANKVKWIAFGVVPQAISSFMSYVLFAFEINIRASAVLGLVGAGGIGLFYDQTLGLFQYKKTAMIILFTLIIVVIIDYVSSKVREKLA

SEQ ID NO: 4377 - protein, 76 aa, Staphylococcus epidermidis
RGDKVSFYHFIQNFVGDETPLGKLATCINQDEDLPMEETTAHNILNYFNQLNYFDDDCIEAVKRSLSLYEQSKVAL

SEQ ID NO: 4378 - protein, 878 aa, Staphylococcus epidermidis
KGDNSMSKSYAKFYKCALQVNPYSYIKYRGLEHEMTEEQYNESIYQYCKTNNISIIGLADHGNVDNSSKLRQYLVSKGILVFPGFEISTSEKVHIVCLFSENTEERELERYLGELGLSNLEEGNSPSTLSFHEITQKVLDRGGFWYAAHVTSDNGILKGKHNNLWQSDKLIAAQIPSKKNEVDPKYTSILKNKDPNYQKQTPFALINAKDISKPEDLALDTSSCLIKMSKLNFESFKLAFRDPDARVKLNSDINNKFPHSSIDKIKISMGYLDNLSLDLSSNLNTIIGGRGTGKSTLIELIRYALDIAPTSQNTNTSFENICKSNLGIGGKVELIVTSHAQYGKQFKIIKRYNEDPIIKDIDNNVSNYTVKDILPNIEVYSQNEIIDLTTNENAKLNILNRFLDKDDRSNDKKEEIKTNLHSNSKSLIKAKEDLENLQEKINQLPKLKEKLKHFNELGIGKKLEVQGKISREEQYIQNTKQIIEDNDISITNIILPFNENYNQQIKHVEIFDSIKNITDNHNKKLKEIKSMFTDLKDTTQNEIEKIYNVWKEKKKNIEKEINRAIKSLDDIEGKTKEDIAHEYTETQKQITSIEPLETQLSRVKTSIETLENERIQLKEDLKEIFDEQLKNLNRCVKKINNRYLKKQVNIKIQPYANVNNLIEFLKEENGLGDSTLKWIKNHQSFNFPKFIKLIKDRDSEAIYEEYKDSGLKKHTADILSNMLYERILKLESIELENIIDIRLNVGSDKDTKFRSLNHLSKGQQCTAILNLLTLSNNDPLLVDQPEDNLDNSFITNNLVENIRKLKINRQFIFATHNANIPVFGDAELIVTMENENGQGSVNNENLGSIDNTLVRNSVIQILEGGDVAFKMRKNKYGL

SEQ ID NO: 4379 - protein, 336 aa, Staphylococcus epidermidis
GSCKMSRYERQTRFAPFGEEGQQKLSSSQILIFGAGALGSHIVDQLARMGAHHIAIVDMDIVEISNLHRQTLFDEEDAHTLISKVEAIKHKVNQININVNLTTYDLEVTSSNIENLIKNVEPDIIIDGMDNFKIRYLINEVCHKYQIPWVYGAAVGSKGSVYGIDHQGPCLKCLLQTIPDTGESCAINGVIPPVISMIASYEVAEAVRYLSGKGFSKQLITIDAFNINYKSMNVDALKNKDCPVCEKHEYTLLESQQERTIEDLCGNAYLFRFPPKAFKHAAHFPGNMVKSTSFAKLIQYQTYEFTLFKDGRMNAYGIHNDEEAHHLYNTLLKSIR

SEQ ID NO: 4380 - protein, 315 aa, Staphylococcus epidermidis
LRCNISKERCIMIKIIATIIVSTLILGSCSTMNEEENYASQSIPASQYKGQGFQPVAEKSAIAHAKKHREEYEKLGEQFFKDNFSLNVKATNVVGSGDGVEVYVHCDDHDIVFNASILFDKEAIHEEGSMRSNDNGDTMSDMVGTVLSGFEYRANKEKMDNLEKYLKDKEDKYHYTGFTDEAITKTQNIGYQNNYFYITTSSTKLRDYRKHFEPLIKESNDDFRKHMKQLKSKKDTYLNTEITTTLFSTLDEYDEKIIRKNSISMAKEIRKEPSIPHNFTFHLLFSNNKLKINDPNINNNQINEYGVFHHDGFKN

SEQ ID NO: 4381 - protein, 72 aa, Staphylococcus epidermidis
NVRKWFIQPSFVMMTWSNEYLINGKFLTAEASKVVMLYGLIDLNKSKLEPCFRNLGPTFANGPNNNVLSPSM

SEQ ID NO: 4382 - protein, 62 aa, Staphylococcus epidermidis
NLIKMEVILLNIKKHWLPIVVVILVVVIFLLVTFARANEGLDNYEQHELNNGEQQYLSKGAS

SEQ ID NO: 4383 - protein, 506 aa, Staphylococcus epidermidis
KFNKLNGGRLMELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNGGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGIGRELGKEGLEEYLVSKHILTNTNPEPVDWFSK

SEQ ID NO: 4384 - protein, 462 aa, Staphylococcus epidermidis
IINKRKKGNAMFGEIWPLISVVLGIIILLTLIIGLKLNTFISLIITSMITALLLGMPLNKIMETIENGMGSTLGHIALIFGLGAILGKLLADGGGATRIADTLIAKFGQKHVQWAMLIAAFIVGIALFFEVGLVLLIPLVFTVAKRANVSILKLGLPMVTALSVTHGFLPPHPGPVVIAKELKANIGEVLLYGMIIAIPVTLIAGPIFNRFAQKMVPTAYTREGDISSLGTQKEFKEEEMPGFGISLLTAILPVILMLISTIVQLITGHEEATNVFEQIVYFIGTAGTALLIAVIFAIFTMGMKQQRKMEDIMKSVTHAIYPIGMMLLIIGGGGTFKQVLIDGGVGDTIAKMFEGTSMSPILLAWIVAAVLRISLGSATVAAVSTTGIVLPLLEHSDVNVALVVLAIGAGSVILSHVNDAGFWMFKEYFGLTVKETFLTWSLLETIISVSGIIFILFIGLFV

SEQ ID NO: 4385 - protein, 300 aa, Staphylococcus epidermidis
YMRKVLIFAIAGFLAQLVDGSLGMGFGASSSSILLTYGIAPAVVSATVHFSEIATTAASGTSHWRFDNVHKPTMLKLAIPGSISAFIGAGVLTFIHGDYIKPFIALFLLSMGFYILYQFLFKRAHEHHHHVGNLSSFKVIPQGFVAGFLDAIGGGGWGPVNTPLLLSSKKIQPRYAIGTVSASEFFVTSSAALSFIIFLGVTQINWFAVIALSLGGMVAAPISAYLVKVLPINILAICVGGLIIFTNSNALLSYFVKDNTISNTVRFIIILAIIILLVFQVVRNKKLSFSYKKSRVNKYN

SEQ ID NO: 4386 - protein, 513 aa, Staphylococcus epidermidis
LESNMITTTQEVNIMAMSDKKDVVLIGAGVLSTTFGSMLKTIAPDWDIHLYERLDRPGIESSNERNNAGTGHAALCELNYTVQQPDGSIDIEKAKEINEQFEISKQFWGHLVKSGEIQNPKEFINPLPHISFVRGKNNVKFLKDRYEAMKQFPMFDNIEYTEDIEEMRKWIPLMMKGREDKGYMAASKIDEGTDVNYGELTRKMAQNLKNSPNVEVQYKHEVVDFERLSNGKWSVKIKNLNNGQVFEHQTDYVFIGAGGGAIPLLQKTGIPESKHLGGFPISGQFIACTNPQVIEQHDAKVYGKEPPGTPPMTVPHLDTRYIDGERTLLFGPFANVGPKFLKHGSNLDLFKSIKPYNITTLLASAVKNLPLIKYSFDQVIMTKEGCMNHLRTFYPEARDEDWQVYTAGKRVQVIKDTEENGKGFIQFGTEVVNSEDHSVIALLGESPGASTSVSVALEVLEKNFPEYAKDWEPKIKKMIPSYGESLIDDVQLMRKIRKQTSKDLELGFYNKAK

SEQ ID NO: 4387 - protein, 351 aa, Staphylococcus epidermidis
YNLKDYKIFIIGGFYMHCPNCGNPIEDDDLFCGECGHKISRHPQSVRNAESEITKAEKNDEEQNITSNNKENNAATHQNVDSTSHDETRSNENDVADSTLQSKQSHNDTQQSNLSTYHQRPQHREIPQNQHNHDQQQSQIGQQAKQVTNESKGFFKSAFTAPDKIIQTNHVFSFKLLLSLLIIGFIVLAILLASVIPVEIGIFGTTRGSLVTSIIFGIILFLVVIVGAIFGLTRLVVRQPIAFKKVLSDYVLINSVSLAILIISVILILAESYSFGGSIALLSLLLFIASGIYLIAKYSTGNQTRISSFYGVIIYIIILFLFIRIFGEAFFHQIFGDFIEELGDLFEGGTY

SEQ ID NO: 4388 - protein, 493 aa, Staphylococcus epidermidis
CNLNLKLIFQGILLMEVFNMTNQLFINNEFIESQSKETMDVINPATGEAFDTITLATEEEVNDAIEKSQQAQLEWERVPQPTRAEHVKLLIPLLEKNRDEIAQLYVKEQGKTLAQAYGEIDKSISFIDYMTSLSMSDKGRVLQNSIANETIQIINKPIGVTAGIVPWNAPILVLMRKVIPAIVTGCSVVIKPSEETTLLTLRLAELFRASTIPAGLFQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDYNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 4389 - protein, 277 aa, Staphylococcus epidermidis
MKLKRGFQKNKTPGRLEMNKVIESDVTLSSMLWLGGEKSMSIYTSGDIAHKCHVSTRTIQYYDKQGILSPNYTSETNRRFYTDKEVEKLELILLLKEIGCTIKEIKVLLKDDSSMKSLYTFLQIKKHEIQQSITDKEHKVCKIEQIQRYVHQNSISPIHYLQDITTYMEESHRLKGVRKKLWLSIALIGSLQYGGLIISIVTRRKKPFLSMMPVVAMYSLWLTKKYKKNVSYVCPNCHHVFNPSVIHFVTASHTPKTRKLQCPDCHEMHYCIEIAKQ

SEQ ID NO: 4390 - protein, 590 aa, Staphylococcus epidermidis
KEIKDIKETCINRRDGGYMVNTNNHISEELDKNLDEMEFLKANSDFLRGTIEQSLANPITGSITQDDAKLLKFHGSYMQDDRDLRDERRKQKLEPAYSFMIRVRVPGGKATPEQWIAMDDISNQYANHTIKLTTRQAFQFHGILKRNLKQSMKNINHAVLDSIAACGDVNRNTMCNPNPYQSQVHKEINDYATRISNHLLPRTNAYHEIWLDGEKVLDSSEEKEPIYGNTYLPRKFKIGIAVPPSNDIDVYSQDIGLIAIVEQDELIGFNVTIGGGMGMTHGNTETYPQLGRLIGFIPKEKVVDVCEKILTIQRDYGNRENRKNARFKYTVDRLGETWVTEELNRRLGWEIKAPRDFEFEHNGDRLGWIEGINNWNFTLFIQNGRVKDTEDYLLKTALREIAEIHTGDFRLSPNQNLVIANVSPEKKEEIQAIIDKYKLTDGKNYTGLRRNSMACVAFPTCGLAMAESERYLPSLITKIEDLLDESGLKEEEITIRMTGCPNGCARPALAEIAFIGKAPGKYNMYLGGSFKGERLNKIYKENIDENEILESLRPLLLRYSKERLDGEHFGDFVIRDGVIAKVHDGRDFHS

SEQ ID NO: 4391 - protein, 199 aa, Staphylococcus epidermidis
FKVKIHKLILGGSHLKKEKVMDWTTFIGVVIVLLFAVIPMMVFPKASEIIITDINSAISNSIGSVYLFMGLAIFCFVLYIAFGKYGNVTLGKATDKPEFNNFTWAAMLFCAGIGSDILYWGVIEWAFYYQVPPNGAKSMSDQALQYATQYGMFHWGPIAWAIYVLPALPIGYLVFVKKKPVYKISQACRPILKGHTDKL

SEQ ID NO: 4392 - protein, 557 aa, Staphylococcus epidermidis
KKSKVELYMKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLESASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRLNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 4393 - protein, 370 aa, Staphylococcus epidermidis
RMTNQKTVGLVVAPGVTERLAENLIQEMPKMLSTHYDHQQEWIFDLVTDPLTGFAESVDEIFGKVADYHDKRQWDYVIAITDLPMFADKQVMALDINMENGAAIFSYPAFGWRPVKKRFKHAIYNIIQELNEAEQESRNYDNNKQIENSVKKQFPLSKIDKETIYMKETDSYHLRYLSSSRSRGMFRLVSGMTFANNPLNMMASLSNIVAIAFTTGAFGLVFTTMWQMAYNFSMWRLFGISIIAIIGMLIWIMMSHDLWEPVNKSNHKHITWLYNLTTIMTLIFAIIIYYIILYLLFLIAEIVLLPSGFLGQQVGLKGPAGIDLYLSIPWFAASISTVAGAIGAGLLNDELIKESTYGYRQRVRYEEQRR

SEQ ID NO: 4394 - protein, 629 aa, Staphylococcus epidermidis
TMTNIGITKYKRWIRLNLSVTNSPFTEGQAKQINELLHTLSPNQQVWLSGYLMANQQSNTSTDSVEQHNLDDNTEAMLHEKEPSVEPEARSITILYGSESGNAQGLAEIFEQRLSDIGNDVTLKSMDDFKPKNLKKVEDLFIITSTHGEGDPPDNAVELHEYIHGRKAPKLDGVRFSVLALGDQTYEFFCQTGKDFDNRLAELGAERLYHRTDCDVDYEEDAEKWMANVINTIDSTPAGTESEQVVSESIKSAKEKKYSKSNPYDAEVLTNINLNGRGSDKETRHIELLLDNFGEEYEPGDCVVVLPQNDPAIVDLLISTLGWSPETQVLINEDGDTLNLEEALTSHFEITKLTKPLIENAAIFFDNEELSEKIQDKEWIQNYVEGRDLIDLLNDFATTELQPENLHQLLRKLPPREYSISSSYKATPDEVHITVGAVRYQAHGRERSGVCSVQFAERIQEGDTIPIYLKRNPNFKFPQDESTPVIMIGPGTGVAPFRSYMQEREELGFEGNTWLFFGDQHFTTDFLYQTEWQEWLEDGTLSKLDVAFSRDTDKKVYVQHKIVENSEQFNRWIENGATIYVCGDESKMAKDVHQAIKNVLIKEQNLSETDAEEYLKQMKRDKRYQRDVY

SEQ ID NO: 4395 - protein, 198 aa, Staphylococcus epidermidis
RSTKRDMCKSETHEGTSFMNILNIKEGQHYIAKIESHSFVDGEGVRCSVYVSGCPFQCKGCYNVKAQNFKYGEPFELEMLEEILDYCAPSYIEGLSILGGEPFCNLFITLQLVEAFRQRFGHTKTIWVWTGFLFEYLKQQDDARKSLLEHIDVLVDGMFIQHLYRPNLPYKGSLNQRVWCIDVQSSLQKEQVIEYLTK

SEQ ID NO: 4396 - protein, 84 aa, Staphylococcus epidermidis
KKANEATNFKAKIEVVSTLFSTKSDFTKNNSKKDLLFLSDDLYHYKEKPENTNITLQLSEPKINSTRAFYDANNPLEYGVHKHE

SEQ ID NO: 4397 - protein, 231 aa, Staphylococcus epidermidis
CMAKVKEKVAVVTGASSGIGEAIANKLSQQGASIVLVGRNEQRLNEIVQQLNNPAKVVTADVTVKSNIDDMLKAVIDHFGHIDIVVNSAGQSLSSKITDYNVEQWDTMIDVNIKGTLHVLQATLPYLLKQSSGHIINLASVSGFEPTKTNAVYGATKAAIHAITQSLEKELARTGVKVTSISPGMVDTPMTEGTDFGERKKLEAQNIADAVVYALTQPSHVNVNEVTIRPV

SEQ ID NO: 4398 - protein, 148 aa, Staphylococcus epidermidis
MSKNKNDYEHMLFYFAYKTFITTADEIIEQYGMSRQHHRFLFFINKLPGITIKELLITLEISKQGSHATLRKLKEEGLIVEQTSKQDRRVKKLFTTEAGDDLIGKLNQAQDELIQQTLQKVGHDWYAMMEELANYREGFKTIEHLKED

SEQ ID NO: 4399 - protein, 250 aa, Staphylococcus epidermidis
FDKKILPYGGHGWKQLGGIKGRKETNFPQDWTIFYWSWWLVYAPFIGLFIARISKGRTLKEVVLGTICYGTLGCVLFFGIFGNYAVYLQITEQFNVISYLNNYGTEATIIEIMHQLPFSTITIILFLISAFLFLATTFDSGSYILAAASQKKVIGEPLRANRLFWAFALCLLPFSLMLVGGERALEVLKTASLLASVPLIVIFTLMMISFLIILGRDRIKLERRADKHKEIERRSLRIVQVKDKPEDDNL

SEQ ID NO: 4400 - protein, 308 aa, Staphylococcus epidermidis
NMKKFWGILLIVMSIALVGCSNSNDSDQSSNEKSSSKSSEKKTDVATEYTKEDEYKELEKEAKDLKQKPVLNEIDALITEKGFTNKTGLQGWEDYKKLVDKVTLADYKYTKESKGSSIEEVNKFFKDKKGVEIKRMKSKEKNIKHINYMYVDPDGKKTGENKQPMSYAQILATFKEGKLVATNIQPGFFALDKKKMVKAKDLEKVKTLEDLTRLKDPKATSYGILQTKYKGKPYTQVSILGSDSDEENDISSAILAYYLFSPTELDSDDNHKYVEVASAPFLSAQNDFSSYQLGVFKKIIESSMSFDE

SEQ ID NO: 4401 - protein, 310 aa, Staphylococcus epidermidis
DKEKCRIQGLRHMKFAYIQSIRNEISIILIILLFFALIFYVFSLPFDAYVLAISIILLLMCVRWWIKYLSFKKNEHLKDKVAYLEHELAHVKNQQIEYRNDVESYFLTWVHQIKTPITASQLLLERNEENVVNRVRQEIVHIDNYTSLALSYLKLLNEESDMTITKVTVDDLIRPLILKYRIQFIEQKTQIHYEKSEDIILTDAQWASIMIEQLLNNALKYAKGKDIWIDFDVANQTLQIKDNGIGISKADIPKIFDKGYSGFNGRLNEQSTGIGLFIVQHIANHLNIQVTVQSELNHGTVFFIHFTKEK

SEQ ID NO: 4402 - protein, 554 aa, Staphylococcus epidermidis
MAEKQYSAAQMVIDTLKNNGVEYVFGIPGAKIDYLFNALEDDDIELVVTRHEQNAAMIAQGIGRLTGKPGVAITTSGPGVSNLTTGLLTATSEGDPVLAIGGQVKRNDLLRLTHQSIDNASLLRSSTKYSAEVQDPESLSEVITNAMRTATSGKNGASFISIPQDVISSPVKADAISLCQKPHLGVPSEQEINEVIEAIKNSKFPVLLAGMRSSSQAETEAIRRLVQKTNLPVVETFQGAGVISRELENHFFGRVGLFRNQVGDELLRKSDLVITIGYDPIEYEASNWNKELDTKIINVDEEHAEITNYMQPVKELIGNIAGTIDMISEHVNEPFINQDHLDELEKLRGEITEATGIKATHKEGVMHPVEIIETMQKVLTDDTTVTVDVGSHYIWMARKYRSYNPRHLLFSNGMQTLGVALPWAISAALVRPNTQVVSVAGDGGFLFSGQELETAVRKNLNIIQLIWNDGRYNMVEFQEEMKYKRSSGVEFGPVDYVKYAESFGAKGLRVTNQEELEAALKEGYETDGPVLIDIPVNYADNVKLSTNMLPNALN

SEQ ID NO: 4403 - protein, 401 aa, Staphylococcus epidermidis
LIGKGDLIIMSNNETITNYTIKPHGGELINRVVEGNERERLIEEALKFKPITLNPWGISDLELIGIGGFSPLTGFMNKEDYTKVIEETHLSNGLVWSIPITLPVTESEADKLEIGDDIALYGEDGQLYGTLKLEEKYTYDKEKEARLVYGTTEEAHPGVKKVYEKGNIYLGGPIKLLNRPKHDAFSNYHLDPSETRQLFHDLGWKTVVGFQTRNPVHRAHEYIQKSALEIVDGLLLNPLVGETKSDDIPADVRMESYEVILKNYYPEDRARLVIYPAAMRYAGPREAILHATVRKNYGCTHFIVGRDHAGVGDYYGTYEAQELITQFEDELGIQILKFEHAFYCEACGNMATAKTCPHDASQHLHLSGTKVREKLRNGESLPTKFSRPEVAEVLIKGLREK

SEQ ID NO: 4404 - protein, 231 aa, Staphylococcus epidermidis
GECLMMAKSYDYQSAFDIIGPVMMGPSSSHTAGAVKIGNSARAVLGDMPKHIEIRYYESFAKTHQGHGTDVAIVGGAMGYSTFDSRIKSSLDIAKDENITIDIIEDEGESIGQHPNCAYIKANTKDGRYIEVIGISIGGGTIKLKGINVNGLNVELNHGLPMLVIDGNMNKAKINHLINDLSDMDLDLGEELIETNDNEGLVVFPLNKAISESALNIIKDKHSDLNVSYIK

SEQ ID NO: 4405 - protein, 357 aa, Staphylococcus epidermidis
RSLKLYGRDIDHNSPFYKGNKSVREGDIVKQDKLANTLTKIKDKGPDYFYEDIGKSVSKQLDNKLTERDFKEFKTEEKEAVSTDYKNNQVYSAPNPLGGTLMLQGLKIDEKENVDNMDRNNFITAMIKSRDVMYKNRDIVNGNEPSNEQHLTDDYLLGELNKVNIGENTDNGSDFDQIRTDNTSTTHFVVIDKNGKLASTTNTLSSYFGTGDYMKEGFYMNNSLGDFSKDKSSPNHGEPHKAPRSFISPSVIVGPNFYMGIGTPGGNKIPTILNEVIVDYLNSDGSLQESINKPRFYNDGGTIFYENAMTDEDINIFKSLGYGVEEKHNDPNFGSVQGAVYDKDKNTVDVGHDVGNR

SEQ ID NO: 4406 - protein, 274 aa, Staphylococcus epidermidis
NELKTLNHLNKMKASQQKISMVTAYDYPSAKQAQQAEIDMILVGDSLGMTVLGYDSTVQVTLNDMIHHGKAVKRGASDTFIVVDMPIGTVGLSDEEDLKNALKLYQNTNANAVKVEGAHLTSFIQKATKMGIPVVSHLGLTPQSVGVMGYKLQGDTKTAAMQLIKDAKAMETAGAVVLVLEAIPSDLAREISQQLTIPVIGIGAGKDTDGQVLVYHDMLNYGVDRHAKFVKQFADFSSGIDGLRQYNEEVKAGTFPSENHTYKKRIMDEVEQHD

SEQ ID NO: 4407 - protein, 223 aa, Staphylococcus epidermidis
TYMKIFIVEDDLVIAESLANELSKWNYEVHVVDNFEKIMEDFRRVEPQLVLLDINLPTLNGFHWCQEMRKVSHVPIMFISSRTDNMDQILAIQMGGDDFIEKPFNLSLTVAKIQALLRRTYDLSIARDEIAVKGCKLIVDEAKLSKDNEHVQLSLTELQILKLLFQNENKYVSRTALIEKCWESENFIDDNTLAVNMTRLRKKLLSIGVDDLIETKKNVGYRV

SEQ ID NO: 4408 - protein, 231 aa, Staphylococcus epidermidis
SLMNEYLQAVLMILLTIVLYYVSKKIQDKYNNPLLNPALIASIAIIIVLLVCGVSYKGYMKGGTWINHVLNATVVCLAYPLYQNKKKIKKYLTIIFTSVLTGVVLNFVLVFTTLKIFGYSKDTIVTLLPRSITAAVGIEVSQELGGTDTITVLFIITTGLIGSILGSMLLRMGGFKSSIARGLTYGNASHAFGTAKALELDIESGAFSSIGMILTAVISSVLIPVLILLFY

SEQ ID NO: 4409 - protein, 449 aa, Staphylococcus epidermidis
ELMKQYDVVFLGSGHAAWHAALTLKQSGKQVAIVEKDTIAGTCTNYGCNAKILLEGPYEVLEEAKQYPNIIDSHNLEVNWKNLMRYKEKVINPMSETLTSMFEQQEIDVIMGKGKLVDAHTIEVNNTTLQSDYIVIATGQHSHQLDIEGKEYTHDSREFLSMQSLPDSITFIGAGIISIEFASIMIKSGVEVNVIHHTNQALEGFNESHVNKLIQKLKDEGVKFYFSENTKSVKPNAQRFIVETESGKMIETDYVLDATGRKPNVQQIGLEKVGIQFSDRGIEVDDYLRTNVKNIYASGDVINKMIPKLTPTATFESNYIAAHILGLNTDAIQYPPIPSVLYSLPRLSQIGVTVSEAKKDDTYMIKDIPFGRQMVFEYQNETEAEMSIVLDSHKRLVGAEIYGNDAGDLVNLLVFIINQKLTAQDLNKNIFAFPGASSGVIDLLKLAMM

SEQ ID NO: 4410 - protein, 155 aa, Staphylococcus epidermidis
IEMKGCLMLISDTNKTYIIEETSNSFTIEKNNDQQHYEVLESINSLSNDSFCVLNHLFVNGGNEEVFESRFLKRNQHLQDVPGFKALRFLRPVVKGRHYIIITLWNSRQAFYDWQNSQAYAQTHKKRGTQKGVDHRIVNRDLSYNIRIELESLNN

SEQ ID NO: 4411 - protein, 497 aa, Staphylococcus epidermidis
TMVKEVVLGIDLGTSAIKIIAVDQLGNVIESVSETLKLYQEHPGYSEQDPNEWFEATKKGIKELIQSTEMSDKIVKGISFSGQMHGLVIVDDNGIPLRKAILWNDTRNSIQCRQIEDIYGERLNYNPILEGFTLPKMLWVQQHEPEIWNRVDVFMLPKDYLRYCLTQTIHMEYSDACSTLLFNPENYEWTRDVGDTFNIGDIYPPLVKSHSYVGNVTSSLAKELGLSSDVAVYAGGGDNACGAIGAGVIHDKSALCSIGTSGVVLNVEYQRVTSYDSNLHLFNHSVPDTYYAMGVTLAAGYSLNWLKQTFFENESFEEILNLAASSKIGANGLLFTPYLAGERTPHGDAQIRGSFIGISGQHTKADFARAVIEGITYSLYDSIKIMRRAGHEMNSITSIGGGAKSRFWLQLQADIFNVQIKRLKHEEGPSMGAAILAAYGLGWFKTIESCVEAFIKVDEVFEPNNENHDLYEQYYSVYEAIYKQTKQLTADLLTITN

SEQ ID NO: 4412 - protein, 366 aa, Staphylococcus epidermidis
LITNKERVLMTKKKRLSPSEWLLKQSKRHKRKNTLYTAIVLLVALVLLIFAVKSIQVEPVKSDTRDKDSIRITYLGNVTLNKHIRQTNLNDVFKGIQDTLDHSDFSTGSLIVNDFSRNQKDNINKNIENIMFLRKHNVKSVNLINESMDNIQATAMMRKIDSQAGYNFLTGNGSNPINSKTVQQDIKGKKIANVSFTDIESNYTNSLKNTTSISLDPAIFYPLIKKLKENNDYVVVNVDWGIPNERNVTTRQKEYAHALANAGADVIIGHNTVIQKVENYKRTPIFYSLGNTTSDNFLSKNQKGMIVQQDWKGSHNQFHITPIQSKDGKISKDNMNKMDHIRFKNNIKDKSIDLKSDQNGGYTFEY

SEQ ID NO: 4413 - protein, 139 aa, Staphylococcus epidermidis
EGTNKMKKTAVLNSHISSAISTLGHYDLLTINDAGMPIPNDDKRIDLAVTKSLPCFIDVLETVLTEMEIQKIYLAEEIKTANAQQLKAIKKLINDDVEIKFIAHSEMKEMLKSPLNKGNIRTGEITPFSNIILESNVTF

SEQ ID NO: 4414 - protein, 299 aa, Staphylococcus epidermidis
CIKNKRMYMIKQNFTTKVYPLKQFEGEYSEVAYAGDSQADDVIVFIHGALLTYKIMTMFEPYFRDYKLIFINCPSRGKSSDLDRDTHTLDDYAARIYDVLTQIVKEQQIKELSIVGYSMGGMIATRLLKYNTLPVSHLIYLHSAAKITPDASMLARLFTSESKRAVLKDEIKAVKNLPQYILDKTIYAQKENALDLVQFIAPIKTIITDMIYTINTDYLPDIDEIKQFPKILFMSGKEDQIIPYTDSQATLEKFKALGGKTKEVIYPGIGHIDFPSVLETQSDGQTGVVDEIKAWISKK

SEQ ID NO: 4415 - protein, 289 aa, Staphylococcus epidermidis
EGEKMNEQWMSALPLDNVKDISPVSGGDVNEAFKVTTVEEDIFFLLVQRQRSEAFYAAEIAGLNEFENAGITAPRVIASGEINGDAYLLLSFLEEGSQGSQRELARLVARMHSQYQQDNKFGFRLPHEGADISFDNSWTETWKEIFINRRMDHLQDELLRVGLWKQEDKKMYERVRKVIVDELSNHTSKPSLLHGDLWGGNYMFLTNGQPALFDPAPLYGDREFDIGITTVFGGFTQEFYDEYNQQLPLAKGSQKRIEFYRLYLLMIHLLKFGGMYADSVQRSMKIILE

SEQ ID NO: 4416 - protein, 602 aa, Staphylococcus epidermidis
MNENNYRRLNKTYKPHYLPGLDGLRAIAVIGIIIYHLNTKWLSGGFLGVDTFFVISGYLITSLLLSEYYRNNSINLVNFWLRRFKRLIPAMMFVVTVVLIYTLLFKPELIISIKHDAIAALFYVSNWWYIIQDVDYFNQFAVAPLKHLWSLAIEEQFYLFFPFILLGLLKFFKKRTTMIILLIISLLSLTAMITIHMYTGNNSRVYFGTDTRLQTLLLGCLLAFIWPPFSFRKDISKGAKASISAIGIVGMAVLIYLFVVVSDQDKWIYSGGFYAISFLTLFVIASVVHPSSVLKKILSFKLFIYIGKRSYSLYLWHYPIIIFMNSYFVQGQIPWFVYICEVILMFVMAEVSYKFIETPIRKNGFKAFTVIPKNLTRFSRTIIVLILLVPSAFIVFGAYDSLGKEHDKQQAAKQKSFKTNQKAKPKKPDENNQDKSSQQHFNPKEASPLLLGDSVMVDIGQVFSEKVPNANIDGKVGRQLIEGKDLINQKYQDYTKKGQSVVIELGTNGEFTKDQMNELIDSLGEADIYLIKVRVPRDYESTNNKIMEQVAKKHKNVHIVDWYKTSEGHSEYFAYDGIHLEYSGVKALSNEIIKKMKEVNEK

SEQ ID NO: 4417 - protein, 77 aa, Staphylococcus epidermidis
VLRFFLGGFGAHRFYHGKVGSGVGLLVLTLLTVWFTFGIPTLIWAIIDAFLIPNWVKEDEERIRQQALSEVKLMKNK

SEQ ID NO: 4418 - protein, 71 aa, Staphylococcus epidermidis
LEYLIHEYVDLIELLLIVILLVSLTSFHPLYMLKLDVILLYFNIEKSLQRSKRRRDTKLYPINLKISFSYK

SEQ ID NO: 4419 - protein, 65 aa, Staphylococcus epidermidis
LKFDSLQSQYDLSFIYITHYLIILYISEYIKEISNVQDNSTLTLKKLKKATEFELRVFPHFNNKS

SEQ ID NO: 4420 - protein, 451 aa, Staphylococcus epidermidis
LKIDQTLTSRIRQLEAYIMKQFLNITQRKFIEWLIILSIFIVSIPNKWTLMISIALSLLLLKRGALGVVQLIILYMLRSQIYTPYDTQEMAHYIVSMKYILIYVIGVFFLFKYVKHWIRNEMILRFIKSTMILMLLYIIMSLVVSNDPIESILKLLNFFIPLILIVMYVSLIKKIKNLINWINQFITLVIAFTFLFIVIAPKSYLIDEESLRSVFKDAHSFAVILAMGLVLYMVTIIKQQDYDVFNLLLLNIGMIELYLSNSRHIFISVILCLMLLLPLSHIKKRIKHPIIGAMILMAIAIINQPYIYHLFIKLILKGKNSQEVFMPSDMNIKAIDYALTEHPFLGSGFGIPMIKASSEIQYFNVATSNIIFGMIIFTGIIGLTLCTIYMLHMVLLVTFPMSITILLFLITIFVNMDYIILFDSVGLGILCYIFWGIYLKEGMYQYNNGQW

SEQ ID NO: 4421 - protein, 180 aa, Staphylococcus epidermidis
WFNEKILTVSIYIVNICESFYTIINRARLKRGGYVKQEQMRLANQLCFSAYNVSRLFAQFYEKKLKQFGITYSQYLVLLTLWEENPQTLNSIGRHLDLSSNTLTPLLKRLEQSGWVKRERQQSDKRQLIITLTDNGQQQQEAVFEAISSCLPQEFDTTEYDEMKYVFEELEQTLKHLIEK

SEQ ID NO: 4422 - protein, 458 aa, Staphylococcus epidermidis
KEDLIMKYIVVGTSHSGYEVIQTLLKEDENADIQVFESADQPSFLSCGIQSYLEDISSSLDDLHYASVDSYKAQGVNIHTNSTVTDLDTDNKTVVVEHQGQTATYSYDKLFLSPGGKPVTPPVDGIEKYKHVLFMRGRDWANQIKERMKDAKKAVVVGGGYIGIEAAEAFAKAGIDTTIVDVADRILNTYLDKEFTDILETNAQQHGLHFKGGETVKSISGNQNGEVTTVVTDKNEYDADTVLFAVGVEPATEWLKDKIDLGKKGIININHQQQTSAKDVYAGGDATLVPFAPVSEDRYIALATNSRRQGVVAAKNMLGKEMTMPRVSGTSGLQLFDYKFGQTGIHGTEIDNYDGNLGQTYVEELIRPQFMQDDTKIHMKIIYDKDTHRILGGQVMSKEDITASINTISVVISAGFTLEQLAVQDFFFQPDYDRPWHYLNVLAQQALGDTFGSDKMLF

SEQ ID NO: 4423 - protein, 543 aa, Staphylococcus epidermidis
CLDESELKGSTLMNKSNLLAPENYNIVTEIEKYASEDHKKAIIYKDNEHENISVSYKELISNANKVGNVFLNHGLKKGDKVLIMMPRAIVTYELYIAALKLGIAIVPSSEMLRTKDLQYRITHGEIDAVISFDSLTKEFENVKEYDQLKKFIVAGHKEDWVSIEDEKEKVSDDLKGADTTRDDLAILSYTSGTTGNPKAVTHSHGWGYAHLQMAPKHWLCIQENDLVWATAAPGWQKWVWSPFLSVLGMGATAFVYNGRFHPETYLELLQNYQINVLCCTPTEYRMMAKLSHLEQYNLEYLHSAVSAGEPLNREVVEQFKRHFNITVRDGYGQTESTLLIGFLKDTEPRMGSMGKGIPGSFVTVIDDDGKEVGPNVKGNIAVPLDLPALFKGYFKDEARTKAASTGDYYVTGDQAHIDNDGYFWFEGRRDDIIISSGYTIGPFEVEDALTNHAAVKECAVVASPHDIRGNIVKAFIILQDDYEASDELIQELQVFCKNEVAPYKYPRAIEFVEHLPKTNSGKIRRVELRDAEIKKYKQQDSSH

SEQ ID NO: 4424 - protein, 270 aa, Staphylococcus epidermidis
KEHETMTNFHSIDATQVTNVTLNVKDLNKLTDFYSNVLGFSIEKQTNQQTVFNIGNLGYTLTLNELNNGRQPEFREAGLFHVAYLLPTRSDLADFLYHANNLNIAMGGGDHLVSEALYFTDPEGNGIEVYHDRPSEDWVWRDGFVKMDTLEVNVNDLMAQRSNEGWQGWPEEGKIGHLHLKTHNLESAYEFYVEKLGFEHISNFPQALFMSTQKYHHHIATNTWQSNKIRTQNEQTYGLCHFDIYQPNANTTHVTSPEGFDITIHGNETK

SEQ ID NO: 4425 - protein, 605 aa, Staphylococcus epidermidis
IELEIKKVFNMSLELPVMLTIVLFLALGIFSQWLASRIKWPSIVVMAIVGLLVGPIFGLANPKEALGPEAFSSIVSLAVAIILFEGSSNLDFRELKGISKAVIRIITIGAGIAWILGAIALHVTMNFPLSISFVIGGLFLITGPTVIQPLLKQAKVKRNVDSVLRWESIILDPIGPIIALTAFYVFQIFEEGIGLVVIILFILKLLAAILIGFGAAFLFNWLISQDKIPQSLMPPIQLVFILLTFSICDEILSESGLLAVTIFGLMMARKKRHDLIFKESDHFIDNASSILVSTVFILITSSLTKDVLLNVLSWQLILFSLVMIVLVRPISVLLSTLGTEITKKERAVVALMAPRGIVVLTVAQFFSSLFMDDKIPMAQYITPVTFGLVFITVVIYGFGFTPLSKLFGVASTEPPGVIIVGESEFSFHLGINLRDHGIPVMMFNLFENTSEKAHEAGFEVFKGNLLSSNDRIYSDLLRYNKCILMTQSFIFNSLAFNELVPEFGLNNVDMMPVSFNDEQARNNLNGPIRNHILFDENHTPRWFNQFITQHNIVEVPAEDYEKITENDMLIYHINEDKEVTFKRSNRDIPEHETGVYGILKNAYLT

SEQ ID NO: 4426 - protein, 191 aa, Staphylococcus epidermidis
HMQEDRKFEVKWRLVNSSTFMYGTKLRFNQDNIYFENPLMPSGTIIHSWYMLTDFAEDRVSPKLPILKKGRQYQFQFNFEVEPEGAAYFKMKFYRKNKEILSHQILKNKKENIVYPREAYSYELELINAGMNHLSFHNIIVQELREDSNQAYEATQYIDPKKKLKVINQIITNIRTHHLDTSNYHRSDTNG

SEQ ID NO: 4427 - protein, 420 aa, Staphylococcus epidermidis
CSEEKEEMSMTNGPIQVNSEIGKLKTVLLKRPGKELENLVPDYLDGLLFDDIPFLKVAQQEHDHFAQVLQDEGIEVLYLEKLAAQSIEDSNVREQFIDDVLAESRKTILGHEKEIKKLFSTLSNQALINKIMAGVRKEEIQLESTHLVEYMDDKYPFYLDPMPNLYFTRDPQASIGRGMTVNRMFWRARRRESIFISYILKHHPRFKDENIPLWVDRDCPFNIEGGDELVLSKDVLAIGISERTSAQAIERLARRIFKNPLSTFKKVVAIEIPTSRTFMHLDTVCTMIDYDKFTTHSAILKSEGNMNIFIIEYDDKAEDIKIQRSSHLKQTLEKVLDVDEITLIPTGNGDIIDGAREQWNDGSNTLCIRPGVVVTYDRNYVSNQLLREHGIKVIEIPGSELVRGRGGPRCMSQPLIREDL

SEQ ID NO: 4428 - protein, 465 aa, Staphylococcus epidermidis
NGEEKIMADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 4429 - protein, 262 aa, Staphylococcus epidermidis
KLLEAVNMFKIGNLELQSRLLLGTGKFENEEVQSKAIEASETNVLTFAVRRMNLYDRNLPNPLANVNLKDFITFPNTAGAKTAQEAIRIAEIANHAGVCDMIKVEVIGDDETLLPDPFETYEACKVLLEKGYTVCPYISNDLVLAQRLEELGVHAVMPLASPIGTGRGINNPLNLSYIIENASVPVIVDAGIGSPKDACHAMELGADGILLNTAISAAKDPVKMAEAMKLGINAGRLSYEAGRIPVKYTAQASSPSEGLGFL

SEQ ID NO: 4430 - protein, 206 aa, Staphylococcus epidermidis
RCMEQIITDFISKWGYTAIFILILLENVLPVVPSEIILTFAGLLSVKSHLSIWTLLIIATIASFIGLLILYYICRLISEEKLYRFVDRHGKWMKLKSKDLKRANDWFKKYGAWAVFLCRFVPVLRVLITIPAGINRMNVIQFTTLSLIGTTIWNFALILLGRLLSDSFDALMNGIHTYSRIMYVIIIIAVIYFVIRYLMKRRRSVK

SEQ ID NO: 4431 - protein, 274 aa, Staphylococcus epidermidis
LWMERLENKIAVITGASTGIGQASAVALAIEGAHVLALDISDQLEETVQSINDNGGKATAYRVDISDDKQVKQFSEKIAQEFGHVDVIFNNAGVDNGAGRIHEYPVEVFDKIMAVDMRGTFLVTKFLLPLMMKQGGSIINTASFSGQAADLYRSGYNAAKGGVINFTKSIAIEYGRENIRANAIAPGTIETPLVDNLAGTSDEEAGQTFRENQKWVTPLGRLGTPDEVGKLVAFLASDDSSFITGETIRIDGGVMAYTWPGEMLSDESWKNSTK

SEQ ID NO: 4432 - protein, 63 aa, Staphylococcus epidermidis
NSTDKASWGSGPQQREFHREIPRTRQVVGNLDNLFKIRCVFNYDKLSSLFCFVTMNCNVKAFR

SEQ ID NO: 4433 - protein, 425 aa, Staphylococcus epidermidis
MKSLDKGFRHLTRKDKLKKLVEYGWLDDENYEILLNHPLINEEVANSLIENVIGQGALPVGLLPRIIVDDKEYVVPMMVEEPSVVAAASYGAKLVNQSGGFKTISSERLMIGQIVFDDVEDTGTLANSIYQIESQIHQIADEAYPSIKARGGGYQRIEIDTFPNHRLLSLKVFVDTKDAMGANMLNTILEAITAHLKVKFSNQNVLMSILSNHATASVVKVQGEIDIEDLHRGERSGEEVAQRMERASVLAQVDIHRAATHNKGVMNGIHAVVLATGNDTRGVEASAHAYASKDGHYRGIATWEYDRSRNKLVGTIEVPMTLATVGGGTKVLPIAKASLNLLNVENAQELGQVVAAVGLAQNFSACRALVSEGIQQGHMSLQYKSLAIVVGAKGEEIAQVAEALKYESQANTAKAQEILMNIRKS

SEQ ID NO: 4434 - protein, 308 aa, Staphylococcus epidermidis
LNLLLNYIKTRGICMDIKHMKYFVEVVKQGGMTNASKSLYIAQPTISKAIKDIEAEMAVPLFDRSKRSLVLTDAGKIFFKKCQEIIALYDNLPTEINSLYGLETGHITISMSAVMSMRKFIGVLGDFHQLYPNITYNLIESGGKTTENLILNDEVDIGVTTLPVDHQKFECISLNKEELTVVLNKEHPLAQKSSIKMEELADENFILFNEDFYLNDKIIENAKNAGFVPNMASQISQWNVIENLVINQLGISILPATIAQLLNDDVKIVHLENAHTTWELGVVWKKDKRLSHATNKWIEFLKERLSEE

SEQ ID NO: 4435 - protein, 479 aa, Staphylococcus epidermidis
QRLLGYLKFTRNYFSVLYIIIRLGGYNMFNFLKPARHIKSLPAEKVDDTYKRLRFQVFLGIFIGYAGYYLLRKNFSLAMPSLIEQGFIKGELGIALSAVSIAYGFSKFVMGTVSDRSNARMFLTLGLVLTAIINLLLGFIPFFTSSITIMFIMLFLVGWFQGMGWPPSGRVLVHGFSVSERGSKTSIWNVAHNVGGGLMAPIATWGISMTALYNFGYLKGFEGVFIYPALLAIIIAIFSYILIRDTPQSQGLPPIEQYKNDYATSTKQTIETELTTKEILFKYVLNNKWVWAIAFTNIFVYFVRYGVLDWAPTYLSEEKHFDLSASGWAYFLYEWAGIPGTLLCGYLSDKLFKGRRGPAGFFFMLGVTIFILIYWLNPPGHAWLDNLSLIGIGFLIYGPVMLIGLQALDYVPKKAAGTAAGLTGLFGYLFGAVMANIVLGFVVQHFGWHIGFVLLTVISILAMLCFILTWNKRGQEQID

SEQ ID NO: 4436 - protein, 62 aa, Staphylococcus epidermidis
SKLLHPLNIKMMIDTIINFFNISAPCYDQFIRLSLYLLHYKKAIVININVNCKLIMFENVKA

SEQ ID NO: 4437 - protein, 317 aa, Staphylococcus epidermidis
QMVLFLQPVFQERLWGGTNLTQFGYDIPNNSTGECWAISAHKNGPNTILNGKHKGKSLKQVWDEDKALFGNDSRKDFPLLTKILDAHDCLSVQVHPDDEYALKHEGEYGKTECWYILDAQPGAEIIYGVNATSKNELEHMIDHHQFDYLFKHVPVKPGDFFYVPAGTVHAIGSGILILETQQSSDTTYRIYDYDRKDKNGHTRELHLNQSKDVIDITTTEPNTTPKTEMINGNCHTQFVANHFFTVEEWSIKDILDFQKPHTYCLVSMINGHGQVSINNKVYKIDKGDHFILTSEDQYIKFVGNMDLIVSFSKDEAY

SEQ ID NO: 4438 - protein, 454 aa, Staphylococcus epidermidis
KESLLGGNSMSKVNHLIDEDERYFAHSGRIKYYPLVIDHGYGATLIDIDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKRYGPLLNGFYHIPFPDKYRGMFEQAKPNTVEEYLAPLKEMFTKYVPAEEVACIVVETIQGDGGLLEPVPGYFEALQELCHAHNILIAVDDIQQGLGRTGKWSSVDHYHFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEEALEKLERGELNQYDISGQGW

SEQ ID NO: 4439 - protein, 320 aa, Staphylococcus epidermidis
QGALILKKLIIVSIIILMLSGCSSFDHRKRESINDKNKMKVYTTVYAFQSLTQQIGGKYVDAQSIYPAGADLHSYEPTQKDMIDIAKSDLFVYSSHQLDPVAAKITNSMTNNSMKLALAEGLKQSDFIHSKDHDENHEHHSHHEESNQDPHVWLDPVLNQKFAFMIKEKLIEKDPKHQAYYNKNYKIVNKDIVHIDQQLQSITKHSKRDKVVISHDSLGYLAHRYGFKQQGVKGMNDEEPSQKEILNIVKDIQHSHAPYVLYEQNITSKITDVIKKETDTKPLSFHNLAVLTKEEQNDDSISYQSLMKKNIYVLNRALNN

SEQ ID NO: 4440 - protein, 254 aa, Staphylococcus epidermidis
KGVCIVLLEVKNVKKVYGRGMNTTMALNQMNLEIDENEFVAIMGESGSGKSTLLNLIATFDRTTEGLIKLDGLPLNQLKNKDIARFRREMMGFVFQDFNVLNTMSNKDNILMPLVLANERPKIMQKRLMEISEQLGIEDLLEKYPSEISGGQKQRIAIARALIARPKLLLADEPTGALDSKTSKNLMCLFRKINQKHQTILMVTHSNIDASYANRVIFIKDGRLYHEIYRGEESQTDYQKRIADSLAILNGVGD

SEQ ID NO: 4441 - protein, 138 aa, Staphylococcus epidermidis
TMPWTMEDYPQSWKNFEELERKKAIDIGNAMLKDGYKESDVIPIATNQAEKWYQHASKEELETLKNKHITQHQEDESANPKLNEENVHVYYEDQLWKVKSTEAKRASDTFDTKSEAVNRAHHIAENKGTKVVEHRKDE

SEQ ID NO: 4442 - protein, 249 aa, Staphylococcus epidermidis
MKFCPHCGNPIKKEQSFCNKCGKHLKTSTQRKSENQIEHMREQQSYISREERQHHDSTFYKEQKHTGWLIVLSIIFVLLIAALLYGAYYAYNHYISDEQSHQTTESQQSNESDQNRDQSTGPSIDVFSDDFDQGYMKSASTSGYRGVYNGMTREEVEDKFGTSNGSVESLKWSYETYGDLAVAYDDNEVVSVGVAPNHISEDQFLSMYNEPDDRNSSQLIYDSNKDNDFSVLVNVKNGDVTVIENVNQI

SEQ ID NO: 4443 - protein, 396 aa, Staphylococcus epidermidis
KGVWKSMEESKNYNLITTIMFISGIIVMASLYTALPLTATFAEDFHVPKSIATLNGVLFSLTYSISCLFYGTISEKYGRIKTILVGMSALVIICLMIGIVHSFTVLLILRALQGVFAASFSPVVMTYTTETYPRVKRVTAISFISTSFMLSGVLGQNMSELVVSYLNWQWVYFILTILYLILVLVIYKNVPESPHKNPDIQLIKFFNNFKDFKDNLKVFYCLFISLTLLIMFISMYDILNEYVTSHQVGGDMSVSSMMKLFGVIGMLLSLLAGRVSSRIGMKRLLTIALTTCIVSIILMGVTTNIILITTFSVLFVAGIAFAIPTVISKIGVVVKNNQGFFLSVNTFVLFLGTAIAPILMLFVGELSNFFLQFLMIAIVGLIALVVSIFMPGDQRS

SEQ ID NO: 4444 - protein, 650 aa, Staphylococcus epidermidis
LNLWDVRERKIGMQQIINSLIHFDRSKIDIAKGIRQGFLMILPALIGYLLGFPMFGILISTGTLAHVYVFSGSPQSMLKTVITCSLSFTICMILGTLTVSQPILFGLLLLIVVTIPYYTFNALKIAGPSSTFFLVTFCLSINLPIAPEEALLRGSAILIGGILATITVILTIIFAKEKAEDRAIHADFKTLHNLLHHFDEPEDFKAYARNAVTEFRNSEKLLITSTSGGNGKLSKRFQKLILLHTSAQGIYSELLELNENHIRPLPSDLVEMMDHIIKNVQQPKQQYRPWSKVVDVAPEFQNLMDHILKIDEMIHANDNQIKYEADIRKPLYSKRIYQNLTFDSIVFRNALQYTVIMAVAIFIALAFNIQKAYWVPLSAHTIMLGNVTTIRTLDRSLARGIGTIIGTIVLSGILAFHIDPIFAIIIMGFSAMMTEAFVASNYAFAVIFITTQVIMLNGLASQNLNIEIAYTRIIDVLIGIAIAVIGIFILARKTASSMLSDAIAELVRKEGILFHYLFSKNKQETNERDRVESLNLNVKISNVTQIYNSANGELFSNKEAVRYYYPSIFALEEISFMLERAMNNKHRQTINDDLMGEYLVVFENIAKHFQFQADLNIRDMQPLPQYNYIRASLMNIQRNCAEQRQAITKD

SEQ ID NO: 4445 - protein, 203 aa, Staphylococcus epidermidis
MKQWMNRLITLIGVLLIILAIYLFSKPYIDNYLHEKDNDHKIENYDKKEKEQTKTSKSTPKIPSDKSKMAGYIEVPDAQIKEPVYPGPATPEQLNRGVSFAEGDESLNQQNISIAGHTFTDRSHYQFTNLKSAKIGSKVYFKTGNQTRKYKITKIRDVKPTEVKVLDEHPNKKNQLTLITCDDYNEETGVWETRKIFIATQIN

SEQ ID NO: 4446 - protein, 232 aa, Staphylococcus epidermidis
GVIFMTGNQMFCRENELDESFKQLASYINIPVGVLLPFKSQCFVRHYNKGQIVYYSSDETTHIYLLLKGNIMRENFNLNGDVYRYLNREKVLFPLNNLFQDKVPNEMCTALTDCEMIGIPRDLIEYLCKNHEEIFVKLFSLLSETQCQHIEYNMALTSKLAKERVTKILRYLCQTVGYDHDEFYEIKHFMTIQLLSDMAGISRETTSHIINELKEEKILFKNSKNWLVSKDL

SEQ ID NO: 4447 - protein, 191 aa, Staphylococcus epidermidis
RSSRKSIQRSRFPQPVAEKSAIAHAKKHREEYEKLGEQFFKDNFSLNVKATNVVGSGDGVEVYVHCDDHDIVFNASIPFDKEAIHEEGSMRSNDNGDTMSNMVGTVLSGFEYKAQKEKYDNLTKFFKNNEEKYQYTGFTKEAIHKTQNVGYQNEYYYLAGNVTNINNYRKYYEPLIKKDSKSFKEGMKKSK

SEQ ID NO: 4448 - protein, 156 aa, Staphylococcus epidermidis
NGKRCREKIINQNRDIVATEKSLPPWKRFLSHFSFYAIALQYFVVQFVIALFLIWLPTYLTEQYHVNFKEMTISALPWLFMFFLILFGWSYFRQDFEYRSITFCCTWRNCDCGICGILNFNFLSSTYRQLICNHFLVITLFRWRTYFYGNELGCSH

SEQ ID NO: 4449 - protein, 208 aa, Staphylococcus epidermidis
GKWRFFIVEIGGIFIFIAITYHKQLTKDDLQHYKHIEEAIDGLLFRTSMNNEENKEMIQSLLQLGFSKDKIIIHSDVTLLEDLHLKRIHFKENDTTAFTYKEAHPDICVSMSTHDVETVKRCYENGLDSVFFGHIFPTSSHPNVPPRSKEAIQQALNVPIPIYAIGGINEHSLQKMPPGFKGICAISYFNNASLEEIKQLRKEWSTHA

SEQ ID NO: 4450 - protein, 156 aa, Staphylococcus epidermidis
REFRIKCFTEEINMNWLKIFYHLLCATTISVILLIITILMDVLLQNTHLTQLLLNIDFLINPDEVPTIIEVLIHLSIGILIYLAFLIIYHYSKSLYHLAYLPLVLIFTLMYPLLVFLAQRPFFSFSWNEFAWWLVAHLFFIILMATCLPIISKKIL

SEQ ID NO: 4451 - protein, 518 aa, Staphylococcus epidermidis
GVIRMVVPFKNEPGIDFSVQTNVERFNEELRKVKAQLGQDIPLVINGEKLTKTDTFNSVNPANTSQLIAKVSKATQDDIEKAFESANHAYQSWKKWSHKDRAELLLRVAAIIRRRKEEISAIMVYEAGKPWDEAVGDAAEGIDFIEYYARSMMELADGKPVLDREGEHNRYFYKPIGTGVTIPPWNFPFAIMAGTTLAPVVAGNTVLLKPAEDTVLTAYKLMEILEEAGLPQGVVNFVPGDPKEIGDYLVDHKDTHFVTFTGSRATGTRIYERSAVVQEGQQFLKRVIAEMGGKDAIVVDNNVDTDLAAEAIVTSAFGFSGQKCSACSRAIVHQDVHDEILEKAIQLTQKLTLGNTEENTFMGPVINQKQFDKIKNYIEIGKKEGKLETGGGTDDSTGYFIEPTIFSGLQSADRIMQEEIFGPVVGFIKVKDFDEAIEVANDTDYGLTGAVITNHREHWIKAVNEFDVGNLYLNRGCTAAVVGYHPFGGFKMSGTDAKTGSPDYLLNFLEQKVVSEMF

SEQ ID NO: 4452 - protein, 956 aa, Staphylococcus epidermidis
RRIRLSNLIQDIKQSLYKGFIDKDSSHKGNFVPRLLVNNKEENVLSTIIDQLHNCQSFCISVAFITESGLASLKSHFYDLSKKGVKGRIITSNYLGFNSPKMFEELLKLENVEVKLTNIEGFHAKGYIFEHHNHTSFIIGSSNLTSNALKLNYEHNLFLSTHKNGDLVNNIKHKFDELWDSSFSLTNEWINEYKQSFEYQTLQKVFDNTVVQNSEIKKFNESKLIKPNLMQEHALKSLESLRNVGGEKGLIISATGTGKTILCALDVRAYSPDKFLFIVHNEGILNRAIEEFKKVFPYEDESDFGLLTGKRKDHDAKFLFATIQTLSKKENYKFFNSNHFDYIVFDEAHRTAASSYQKIFNYFKPNFLLGMTATPERTDELNIFELFNYNIAYEIRLQEALESNILCPFHYFGVTDYIQNEMSQEDAFNLKYLASNERVEHIIKKTNYYGYSGDVVKGLIFVSSRGEAYQLANQLSKRGISSVGLTGKDSIAYRTETIQQLKEGSINYIITVDLFNEGIDIPEINQVVMLRPTKSSIIFIQQLGRGLRKSTNKEFVTVIDFIGNYKTNYMIPIALSGNKSQNKDNYRKFLTDTTVLNGVSTINFEEVAKNKIYNSLDSVKLNQPKLIKEAFNNVKDRIGKLPLLMDFINNDSIDPSVIFSRFKNYYEFLIKNKIIENELSINEFKNLTFLSRQLSPGLKKVDIDVLKEVIQNDVTYENLTKKMLNINNDISEYDINTSLSILDFTFFKKTIGKTYGLPLIQYKDNLICLANEFKEALNKPLFNTFVHDLIDLANYNNDRYQNKKNSLILYNKYSREDFVKLLNWDKDESGTINGYRMKHRTLPLFITYDKHENISDNTKYDDEFLSQDELKWYTRSNRKLTSPEVQNILKHEENNTDMYIFVKKRDDEGKYFYYLGKAKYIKGTEKQDYMPNGNSVVTMHLSMNTSIRDDIYRYIT

SEQ ID NO: 4453 - protein, 69 aa, Staphylococcus epidermidis
PFYSCFKVKFFKKYEIDLKKDILFMKSKLNERLEMKNRDCGSMKVYKKSRTEFNLNSLFYSLILYRNIC

SEQ ID NO: 4454 - protein, 287 aa, Staphylococcus epidermidis
KSNRKTLKLLYGYIKMKINVLCEKRDNMDIKQSSEKQGRPHHLSDSRTVLKRNFILIPTYILLQSIIPIIVVFGSLGITAMITQQAPPQWLYHCSLSLSFVIAQGLILIIFYKIHQSVINDVMKQQWIIAKNKIIKIVIVAIVVYLLLLIIRVIGTSLPNHLSYHLTQSEQRTLGLFKSPYVLLVTFISMVFLRPMVEQIIYRYLIIHELGKVWNRQFVIGLSIVIETIVHVYDMASIFEIFPYIVIASAATILYIKSRDNLIVAYIFQVILQCILFIEILCKYTNF

SEQ ID NO: 4455 - protein, 285 aa, Staphylococcus epidermidis
LQLRVKRRKASDKVKDNNEVLKLFIVSDSIGETAQRMIHATLTQFPDLTQVEIKKFPYIKDEQEFLNVLQLAKEQNAIVATTLVSESFNALGHQFANEHQIPYVDYMSELISIIKQHTHAKPLMESGALRKLNDEYFKRIEAIEYSVKYDDGKHFTDIGEADALIVGVSRTSKTPLSMYLANKGYKIANIPLVPEVAIPDNVFQQKNLKVFGLTASPNYIANIRRNRAETLGLSSESNYNSLERIKKELSYAEEVFRKLNATVINTEYKSIEESAFYIEKFLAKR

SEQ ID NO: 4456 - protein, 586 aa, Staphylococcus epidermidis
KGRLFVKMAQIKANEALVKALQTWNIDHLYGIPGDSVDAVVDSLRTVRDQFKFYHVRHEQVASLAAASYTKMTGKIGVALSIGGPGIVHLLNGMYDAKMDNVPQLIIAGQTNSTLLGTKFFQQTNISKMVDDVAVYHHQIQKGDNVFEITNEAIRTAYEKKGVSVIICPNDLLTQKIKDTTNRAVDTTKPKPASPKFKSIKKAAKLIDKAKKPVMLIGLGTQHAKDELREFIEAAKIPVIHTLPAKTILPDDHPYSIGNLGKIGTKTSYQTIQDADLLIMAGTNYPYVNYLPKKNIKAIQIDTNEENIGARFKINVGILGDSKVAFHQLTENIKHVAKRPFLDKTLERKAVWDKWMKQDLNNDNSPLRPERLMKAINANLKDDAIISADVGTSTVWSTRYLNLSVNNKFIISSWLGTMGCGLPGAMAAKIAYPNRQAVAITGDGAFQMVMQDFATAVQYNLPMTIFVLNNKQLSFIKYEQQAAGELEYAIDFSDMDHAKFAEAAGGKGYVVKDVSRLDNIVEEAMAQDVPTIVDVHVDPNAAPLPGKIVNEEAFGYSKWAYRSITEDKNLDFDQIPPISVAAKRFL

SEQ ID NO: 4457 - protein, 300 aa, Staphylococcus epidermidis
GVESMNKEQLEKMTHGKGFIAALDQSGGSTPKALKEYGVNEDQYSNEDEMFQLVHDMRTRVVTSPSFSPDKILGAILFEQTMDREVEGKYTGDYLADKGVVPFLKVDKGLAEEKNGVQLMKPIDDLDETLDRANERHIFGTKMRSNILELNEQGIKDVVEQQFEFAKKIIAKGLVPIIEPEVNINAKDKSEIEKVLKAEIKKGLDSLNDDQLVMLKLTIPTEANLYKDLADHPNVVRVVVLSGGYSRDEANKLLKDNDELIASFSRALASDLRASQSQEEFDKALGDAVDSIYDASVNKN

SEQ ID NO: 4458 - protein, 476 aa, Staphylococcus epidermidis
GHMRYRMTLQNHLKHRILLIYGDNSLKRCYMINLFENYNQETQELHQSLKRAGYNHFTIVINDDGFLPDDVTSPYRFFTAYQIYEDDTPAFFNDIDTPPFWEIKGDATMATITDMGELRGKIFYKEHYKTRVVSHVEWLDSKQRLRSVDYYTKEGFKFAETVYDLLGNAILKKYMTREGKEVIYENYVTNDVVVEYEGKSYFFESYTEWIKFYLSEMGIEIKEVIFNTLSTPFLAIYHLPTLKKGILFWQEQSQGYVPGNMKVMLSPNLQSRFAVIVPNQNEYKLIKEQLSREEQQAVYASGYLYDTYKRNHYSKNVLTLTNSDQIPHVETLVRLHKDYQFHIGAKTEMSSKLLSLSQYENVKLYPIIKEQTVQTLYQQCDIYLDINEGNEIGNAVRSAYNHQLLIMGYKEVVHNQDFVAIENQFLVNDISQLSNALKEIGNHRGQFETRLALQQRHANAVPVSTFKYALVQALSG

SEQ ID NO: 4459 - protein, 260 aa, Staphylococcus epidermidis
MVMSNTALCLTALLLLIPIFISYKEGLHIIKDLVIATIRATIQLLILGFLLHYIFEINEKWLLVLCVLVIIINASWNTISRASPVMHHVFWISFVAIFVGTALPLAATVATGAIKFTANEVIPIGGMLANNGLIAINLAYQNLEKAFVQDVSDIESKLTLAATPKLASKSSIRESIRLAIVPTIDSVKTYGLVSIPGMMTGLIIGGVDPLQAIKFQLLVVFIHTTATIMSALIATYMSYGQFFNARHQLIARTQRTRQSS

SEQ ID NO: 4460 - protein, 174 aa, Staphylococcus epidermidis
KGWRIYALKKFSATIVVIILICALGFSLYAAINHHTNSNKNDKKIEHNRKNKQNDTSNQNRDTNQHQDQTQPTNNDYNNDNQSDTEQPAQQPNYHQYPNNNQQSGSNKNNSSENNKQKPNQNKTNQSDYQPSQSTPQQSSQPNNNQSDSQQNGNSNNNSNNQNHGTNDNQNKNR

SEQ ID NO: 4461 - protein, 451 aa, Staphylococcus epidermidis
FIRRIDMKVKSISRFFSMKKVTLSFVTLFIGVGTIGSYNQYADASMKTQQTHVTKSSPTQKTTSNFKRSVKDTSVKSRATSIKRATSTKQAISPKTSSTKKTTIAKKSTTVNKTRTTTKTQPTIRKSSTTSTRSKTMPTSVKRTTSHKATTVSPTSKAKISTKTQQSTKSHTTSVKKNTTQLSKTKSPSTSTKSKTVQSSTTKAQPTLSTQVSTTTKAKQFSTPTTSKTDSSKSLVSLASTERKIDKYQSMTQLEKETTEGVHWRKDTKNTGNQVLIVAPHGGSIEQSTTELTKTLADKGNYDYYALESIRPKNNSELHVTSTHYDDPTLNQMIKNRTATISIHGASGTEEIIYLGGPRSDLRNAIEKQLVGCGFTVKVPPEYLGGQNNKNFINKEDNNTGVQLELTTALRKAFFKNGDTSTKNRTNKENWTPTMEAFINALYEGINQTYS

SEQ ID NO: 4462 - protein, 162 aa, Staphylococcus epidermidis
LLIGRNKCMKGSKKLNELLEDNQKKLKKLFKYDHKKALAFTPEDREKVKDKFGVYVIFDEKKPVFVGQTGGYSSTHQPINSDLYTKLGQYNSRSETGTTKFRKAYAQNKDLNPNHLKDITADKYGFTFQYIKVKDEPAFINVLEILALEYAKNKGYELYNFQ

SEQ ID NO: 4463 - protein, 2137 aa, Staphylococcus epidermidis
ENYGEFIMTKKEKDYKKSLEQQKTRVKIYKSGKSWVKASINEIELLKTMGLPFLSKNEIQENVTEKTKGHKLKKSAAKTTALVGGAFTFNMLNNHQAFAASETPITSEISSNSETVANQNSTTIKNSQKETVNSTSLESNHSNSTNKQMSSEVTNTDQSSEKAGISQQSSETSNQSSELNTYASTDHVESTTTNNDNTAQQDQNKSSNVTSKSTQSNTSSSEKNISSNLTQSIETKATDSLATSEARTSTNQISNLTSTSTSNQSSPTSFANLRTFSRFTVLNTMAAPTTTSTTTTSSLTSNSVVVNKDNFNEHMNLSGSATYDPKTGIATLTPDAYSQKGAISLNTRLDSNRSFRFTGKVNLGNRYEGYSPDGVTGGDGIGFAFSPGPLGQIGKEGAAVGIGGLNNAFGFKLDTYHNTSTPKSDAKAKADPRNVGGGGAFGAFVSTDRNGMATTEASSAAKLNVQPTDNSFQDFVIDYNGDTKVMTVTYAGQTFTRNLTDWIKNSGGTTFSLSMTASTGGAKNLQQVQFGTFEYTESAVAKVRYVDANTGKDIIPPKTIAGEVDATVNIDKQLNNLKNSGYSYVSTDALQNSNYSETSGTPTLKLTNSSQTVIYKFKDVQGPQISVDSQTREVGKTINPITITTTDNSKDVLTTTVTGLPSGLSFDQTTNTITGTPSEVGTTTVTVNTTDATGNVTSKQFTITIQDTISPVVNVTPSQASEVFTPINPITITATDNSGKVVTHTVTGLPQGLKFDASTNSIVGTPTQIGTNTITIESTDASGNKTTTKINYEVTRNSASDSTSTSIVNSVSTSISNSTSLSDSVKASQSLSTSKSLSESLSASTSNSTSIQASESASTSKQLSESASTSTSDSASESARKSESTSKSTSLSESTSTSVSDSASVSTSESASTSTSVSGSTSTSISDSTSTSTSDSASIKASESASTSKLLSESVSTSTSDSASTSTSVSDSNSASTSLSKSTSTSVSDSTSTSTSDSASTSTSESESDSASTSLSESTSTSVSDSTSTSTSDSASMSASESESNSKSTSLSESTSTSLSGSTSASTSDSASTSTSESESDSTSTSLSESTSTSLSGSTSASTSDSASTSTSESDSTSESTSLSESLSTSVSDSTSASTSESASTSTSESESNSASTSLSGSLSTSISDSTSTSTSDSASTSTSESESDSTSTSLSESTSTSLSDSTSTSTSESASTSTSESDSTSESTSLSESTSTSVSDSTSASTSDSASTSTSVSDSESASTSISESLSTSVSDSTSTSTSDSASTSTSESDSTSESTSLSESISTSVSDSTSASTSDSASTSTSESESDSASTSLSGSTSTSLSDSTSTSTSDSASTSTSESDSERASTSLSGSTSTSLSDSTSTSTSDSASTSTSVSDSNSASTSLSGSLSTSVSDSTSTSTSDSASASTSESDSERASTSLSGSTSTSISDSTSTSTSDSASTSTSVSESNSTSTSISESLSTSVSDSTSTSTSDSASTSTSVSDSDSASTSSSESVSTSDSESTSTSTSDSASTSTSVSESNSTSTSLSGSTSTSVSDSTSTSTSDSASASTSESDSDSASTSSSESVSTSVSDSTSASTSESASTSTSVSDSNSASTSLSESTSTSLSDSTSMSTSDSASTSTSESDSDSASTSLSDSTSTSVSESTSTSTSTSVSASNSTSTSLSDSRSTSLSDSTSTSTSESGSTSTSESDSDSASTSLSESTSTSISDSTSTSTSDSASTSMSVSDSNRASTSLSDSTSTSVSDSTSASTSESASTSTRESESTSASTSLSESTSTSVSDSTSTSTSDSASTSTSESDSNSESTSLSESTSTSVSDSTSASTSASASTSTSVSDSNSASTSLSGSTSTSVSDSTSTSTSASASTSTSESDSDSASTSLSGSTSTSISDSTSTSTSDSASTSTSESASTSTSVSESDSESTSVSESSSTSVSDSTSTSTSESASTSTSESESTSESTSVSESSSTSISDSSSTSTSMSTSETFTSQSPINSESQFIGDSLSEDTIVTQSKNTNMLNKTGKDYDLQEQRGYTDSEQHNETQSNQADNHSNNLDLLHQNRLQDKVVKQPTKGEDGVVSNGFIVAVAIVLAIFGLAKKSRKDDDDQDGSK

SEQ ID NO: 4464 - protein, 378 aa, Staphylococcus epidermidis
ERSGLLMHDVLIIGSGVIGMSIARHLSATHLDVAVIDRDVPGKHASYKAGGMLGAQNEFTEDSDLFQLAIESRAMFPQLSKSLLDETGIDIQFKNSGLIKIANEHDDISSIKRQYQFLNSQDRSVKQLSDDDLLQLTHGEVKPSYAAIHIPHDGQINAHHYTLALLESMKLRDIKRYESTEVTSIERHNGYYSVKTDQSSTIEAHKIIVAGGAWSSQLLTQYHLQRQVIGVKGEVILLENNDLSLTETLFMTNGCYIVPKQPNRFLIGATSEFNNYSVGTTDEGMDWLLRHAYHRVPQLKDSHILKKWSGVRPYTEKEMPVMDQIDDGLYVISGHYRNGILLSPIIGRDIANWLLSGIKPSRYSSFTVTRRNNHEVYH

SEQ ID NO: 4465 - protein, 527 aa, Staphylococcus epidermidis
ILVGRRFWNMKRFIPAWYSRNRWWESTSRPFYLKKQYTDFDDMISLMTMHSSNNVDYQLIVLNFSPYLRTFLHRYDLYESHYWSVFDEIQGVGHQTPQAIDYRDLSWPEGTEFIFTPFQIQAITGDNTFSKIHFSQEGYLMWVEDYKYSTIQRRFVFDDRGFISAVRTYTPDGDNNKKHYFSKDGEEIFVEDLNVNTVTINKNFQSKFKRVTYSSMAELIEEKFQSYVERELNEDDSVIVASDERHNSMMARTIDASSLCFSIFTERNKVVTQDLYDSISRAYYCLVDTQANQNMIEHYAGLNMNDINLLRVTPFDAKSLPNQSSQLYDTYIGLWIDGLDEIEIREIVNSLFQYIQHKDGYKLKILTKSRDNLTENLIDEVAHLNDLYHQEKKEISDVIEDVIQNKKETIIDIETVPFEEDLVSVISKLRVVVDLSLEPKLFLQICCIGAGIPQINKKRTDYVKHMHNGYIIDDISQTVESLDYFLAHLKNWNYSYAYSMRLTDDFSSINIIHQINQLFKGDVSSGT

SEQ ID NO: 4466 - protein, 295 aa, Staphylococcus epidermidis
IGKGVYRLKKIKKAIIPAAGLGTRFLPATKAMPKEMLPILDKPTIQYIVEEASKAGIEDIIIVTGKHKRAIEDHFDNQKELEMVLENKGKADLLEKVQYSTDLANIFYVRQKEQKGLGHAIHTAKQFIGNEPFAVLLGDDIVESDTPAIKQLMDVYEETGHSVIGVQEVPESDTHRYGVIDPSAKGGSRYEVRQFVEKPKQGTAPSNLAIMGRYVLTPEIFDYLETQQEGAGNEIQLTDAIERMNSKQKVYAYDFEGNRYDVGEKLGFVKTTIEYALKDPEMSHDLKAFIKQLDI

SEQ ID NO: 4467 - protein, 226 aa, Staphylococcus epidermidis
REEGMIMNQMNQTIIDAFHFRHATKEFDPTKKISDEDFNTILETGRLSPSSLGLEPWHFVVVQNKELREKLKAYSWGAQKQLDTASHFVLIFARKNVTAHTDYVQHLLRGVKKYEESTIPAVENKFDDFQESFHIADNERTLYDWASKQTYIALANMMTSAALLGIDSCPIEGFDLDKVTEILSDEGVLDTEQFGISVMVGFGYRAQEPKHGKVRQNEDDIISWIE

SEQ ID NO: 4468 - protein, 259 aa, Staphylococcus epidermidis
YSRGVTYMALITMNYNSPTIGMHQNLTIILPEDVTFFGSSTTAKHLKSMLLLHGLSSDETTYIRYTSIERYANEHQLAIIMPNVDHSGYANMVYGHSYYDYILEIYEYVHQILPLSRKREDNFIAGHSMGGYGTIKFALTQSDKFAKAAPLSAVFEAQRFIDLDWTDFSPQSITGNNTQIKGTELDTYYLLDQAIDANVDIPELFIMCGKEDFLYHDNLQFIETLNKKGVSYKFEDGPGDHDYAYWDRAIKRAIKWFVQ

SEQ ID NO: 4469 - protein, 513 aa, Staphylococcus epidermidis
FIGGNKMKNFSKFALTSIAALTVASPLVNTEVDAKDKVSATQNIDAKVTQESQATDALKELPKSENIKKHYKDYKVTDTEKDNKGFTHYTLQPKVGNTYAPDKEVKVHTNKEGKVVLVNGDTDAKKVQPTNKVSISKESATDKAFEAIKIDRQKAKNLKSDVIKTNKVEIDGEKNKYVYNIEIITTSPKISHWNVKIDAETGQVVDKLNMIKEAATTGTGKGVLGDTKQININSVSGGYALQDLTQQGTLSAYNYDANTGQAYLMQDKDRNFDDDEQRAGVDANYYAKETYDYYKNTFGRESYDNQGSPIISLAHVNNFQGQDNRNNAAWIGDKMIYGDGDGRTFTALSGANDVVAHEITHGVTQQTANLVYRSQSGALNESFSDVFGYFVDDEDFLMGEDVYTPGVGGDALRSMSNPERFGQPSHMNDFVYTNSDNGGVHTNSGIPNKAAYNTIRSIGKQRSEQIYYRALTVYLTSNSDFQDAKASLQQAALDLYGDGIAQQVGQAWDSVGV

SEQ ID NO: 4470 - protein, 266 aa, Staphylococcus epidermidis
TRGGVVHMGKVYLVGAGPGDPELITLKGLKAIKEADVILYDRLVNKEILNYASPSTKFFYCGKDPHRHSLPQEETNKMMVTLAKKGHIVTRLKGGDPFVFGRGGEEAEELACHNIHFEIIPGITSGIAAPAYAGIPVTHRDYSSSVAFVTAVNKPGMDKGKYWQHLANGPETLCIYMGVKRLSEICELLIQYGRSSETPVALVHMGTSKQQMTVTGTLDTIQERAHHIQNPAMIIVGEVVKMREKINWFVEQATVQNETLTEMSST

SEQ ID NO: 4471 - protein, 131 aa, Staphylococcus epidermidis
LFFIKEGCLLMSQIEFKDVSKVYPNGHVGLKDINLNIEKGDFAVIVGLSGAGKSTLLRSVNRLHDISKGDITIEGQSITKARGKKLLEMRRSIGMIFQHFNLVKRSTVLRNVLSGQGRIPSYLENDTGSFS

SEQ ID NO: 4472 - protein, 77 aa, Staphylococcus epidermidis
LYFIILLLKIIRIFMSFVTKYVNIHSNLKLIYLFNYHFIYISFLLLVGFISLLLCGHTYARQTVALPQGAIRSFVFF

SEQ ID NO: 4473 - protein, 296 aa, Staphylococcus epidermidis
RCLMDFIAILIGLGPLLGWGLFPTIASKFGGRPVNQIFGATVGTLIFAIVLALFKGIGLPGGMALVFSLISGAGWAFGQIITFKAFELVGSSRAMPITTAFQLLGASLWGVFALGNWPGITNKIIGFLALLVILIGARMTVWTETKQQEYSKNLRSAVILLLVGEIGYWIYSAAPQATDIGGFKAFLPQAIGMVIVAVIYALMNMSKGNAFKEKVSWQQIISGFFFAFAALTYLISAQPNMNGLATGFVLSQTSVVLATLTGIFFLNQKKTSKELMITIVGLVLILVAASITVFIK

SEQ ID NO: 4474 - protein, 107 aa, Staphylococcus epidermidis
VVIIETEYYCHLLSVVTLPIGYFLVLNHHVIQVLQLQGGIIMKCIINGDLFTFDQNQSIQEVLHSLELDPKRVIVELNKELIKQDKYEEYTVREDDRLELLEIVGGG

SEQ ID NO: 4475 - protein, 494 aa, Staphylococcus epidermidis
GRIMFPPSGGMSNYAQYTHGSLLGFIAAWANWVSLVTIIPIEAVSAVQYMSSWPWDWAKPMGSLMKDGSISTYGLIAVYIIIAIFSLLNYWSVKLLTSFTSLISVFKLGVPILTIIMLLVSGFDTGNYGHSIGTFMPYGSAPIFAATTTSGIIFSFNAFQTIINMGSEIKNPEKNIARGIVISLTLSAILYIVLQSTFITSMPSSMLHEHGWSGINFNSPFADMAILLGLNWLAILLYMEAVVSPFGTGVSFVAVTGRVLRAMEENGHIPKFLGKINKKYNIPRVAIAFNAIISMVMVTLFRDWGTLAAVISTATLVAYLTGPTTVISLRKMAPKMTRPFKANILKFMAPLSFVLASLAIYWAMWPTTAEVILIIILGLPIYFFYEYKMNWKNTKKQIGGSLWIIIYLIVLAFLSFIGSKEFKGLNWIHYPWDFLVIVIVALIFYQLGTTSYFESIYFKRANKLNKKMGDKLRKTRKKARHKDWKERDRQEQNQ

SEQ ID NO: 4476 - protein, 64 aa, Staphylococcus epidermidis
FIVIKAIYVTPLLYYLLFYLFFSLIYRKNATLTIDYINFYTFQCGTKILFSILNKLIQYRLSNL

SEQ ID NO: 4477 - protein, 67 aa, Staphylococcus epidermidis
PIPIKINPKIKNIINRTRDFSCVLLLFLSNNCKEFLNDILKLLITNNMIIKLSSMVNVIFIDKTSNG

SEQ ID NO: 4478 - protein, 209 aa, Staphylococcus epidermidis
IHHISSIRNGVINVKKISLIATTVLTGLLLFPSVNDTTTHAAEVTSHDAQAVAIQAMKNSGGNPDLQNFKKVKDKGDYFTIDINNKSGAGVGTYKVYKNGVVLYKSGNYGEYSQLNTRQCYVAQDIATTSSQVKRHSTQQTQAVDSTRELNSYYVGQVQSSDLPQQSSSDMLPNTGMKDKNFNTNGIISLFLLTAGFITLYHQPLRKMS

SEQ ID NO: 4479 - protein, 63 aa, Staphylococcus epidermidis
LNHIFFFHIREASIITTVPVSIAIKSVTVKFRINKNGYPPFVKVNNRFLIYLSKIRTIQHVFL

SEQ ID NO: 4480 - protein, 673 aa, Staphylococcus epidermidis
VTNMTFKILWKMIKQNFVNQRHIIVPFISVISILFGIEYILLSLTTNIYFNEHHPELKISAIIGIVFMTMLLFIFLIYANHFVMNHRKKEFALNMVLGMEKKHLRLIILIELFIQFIISAILSIVGGYLFGELFFMLFNKLVNTHQPQLSDYPFDVLSMKITLTMLLSLMIILFVINNFKISFKNSLQLLLKNKSKTHEKSRVRLIIFLILGLIFIGIGYYLAIKPNTAIGSLGIIFFAILSTLIGTYLLFVSLGSIVLEMLQKLDYYYYKPNHFFFIAGLKSRVKSSAIGLATISFMCTFLIVTLSMTVSTYRNMDHRFEFAFKNDYAGYYIGDFHKDSKLQRKIENLKKDIRQEVPTGQFKIYARGMVGAELQGGLKHKKLKRQTVSSGLFNFGNKQKFNSFISIYNKSDYNKNNKKIKLDDDEIAISTSVSLFKKMKTLNIFGKTYRVKYIESTNIDNLLYADGITLIVNQQQLMDRIVNEYRNHNDENLIITPNQVQTAVEFNVLKEKDKLNHRIKKIGVQHDIEFQVKKQNLLMWKQVNSSLVFVGSVVSLVLLIGIFLMMYYKQVSEGHEDRDAYITMKQLGLDEILIKKTINKQVIWVFLIPVIVAIIHTLAAFRIIYSVLGIVGQYDLGLYATSYVGVIVVFIIFYSIMYWITSRIYYTMINGKH

SEQ ID NO: 4481 - protein, 541 aa, Staphylococcus epidermidis
RMILVQLILFIKLISYLKVMFQVARKFRVLQVGGHDLGSLFNQKSNVEWDYFDVGLFDFESGYQDVVVHILDEKGQFDFVFVREKYSDSLMKLLSLVSTPYNTVIDNEYWDNQYQQDKTIQRNFIKPLIYENEEQLQQKLEAVTFPGQYGDKVKPIHCRVSIHFDGSYQFNGNESIEVSGRFGESYQPLITWSQNIIADANKVNQIWPEFKVEGDAKIQYTLRLTPVYSTDQPVEKLIYEQDDLDTPIELPARPYQTYVSVSIKAKGKGTLFIGAIHKRWSRLELGQFILGGKRYSDENKQEFIHYFHPGDLKPPLNVYFSGYRTAEGFEGYFMMKRMNAPFILIADPRIEGGAFYLGSENYEQAIRKVIQNALDYLGFANNQLILSGLSMGSFGALYYATKLNPAAVIVGKPLINLGTIANNMKLVRPNDFGTSLDILRLNQNGITNKDVVQLDNHFWKQIQHSDLSMTTFAIAYMEHDDYDKYAFQDLLPVLTKQHARVISKRIPGRHNDDSATVTHWFINFYHLIMEERFGRVTHARR

SEQ ID NO: 4482 - protein, 177 aa, Staphylococcus epidermidis
ETNMKEKRSNVRWYFAIGFFFIGVIAYMDRSNISYIAVPMMKDLGLTKTQFGLLASFFSLGYALMQVPSGMLAEKFGPRKMITVALVWWSAFTILTGMIKHHGLLYFIRFLFGVGEAPMYPSNAVFNSFWFAKNEKGRASIALLAGSYFGPVLAPIITIAIVNAFNWQAVFYIFGVV

SEQ ID NO: 4483 - protein, 382 aa, Staphylococcus epidermidis
VKCIFSQKLYISIQQTWYNYCEKFHIINGGIDMKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKDDALVMLSDILPTGYEIGVLKGKVKPGCTVAIVGAGPVGLAALLTAQFYSPSKIIMIDLDDNRLETAKELGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 4484 - protein, 66 aa, Staphylococcus epidermidis
RRRIMFSTGNKAKKTIFGAMTCSKCGKTLNNDENITIKINTKELKGYTHLSSWADAQYKLCENCSE

SEQ ID NO: 4485 - protein, 89 aa, Staphylococcus epidermidis
IIFIFKLFLSLNLKTNKYVYKIYNLIHTKKHLKCFHYSFKVLIKLNIYFNGYLHHDRHLQYFYLYHKQHLGHCQSLDHYAFLQHHNQDF

SEQ ID NO: 4486 - protein, 103 aa, Staphylococcus epidermidis
IPFIKASKLSLSKRPSSIKAKFQIVVPIKDKVVNCITFIRLMPAGIVINTRSTGTKRHKNTAHAPYFLNQSFARFKSLLFNFIHLPCRSTKRYNFSSEISLQI

SEQ ID NO: 4487 - protein, 111 aa, Staphylococcus epidermidis
VYIMYENIQNIEDFYRFINAHALAVVHIMRDNCTVCHAVLPQIQDLLKDYPKAQLGVINQSNVEAIAGELSIFTVPVDLIFLKGKEMHRQARFIDMQSFEKQLYMMQNAID

SEQ ID NO: 4488 - protein, 207 aa, Staphylococcus epidermidis
EEIIMNMPLMIDLSNKKVVIVGGGKVATRRAKTLLAYTKHIHVVSPTITDTLQKYLETKQITYEKKHFEPQDVENADVVIAATNQSDVNNDVGAALSKNVLFNHAGQADLGNITFPNFLKRDKLTISVSTDGASPKLGQRIIKDLKDTYNKDYSMYIQFLYESRQYIKSLKIEPSDKQALLEQILSDKYLDEKKQQDFIRWLKSQVK

SEQ ID NO: 4489 - protein, 68 aa, Staphylococcus epidermidis
FLYIRHLVNLVYWYLLNYTKGPYFSKYFNIKLHICTKYFGETLEGTGQAEDYRLKLSDKKASQQYEVL

SEQ ID NO: 4490 - protein, 513 aa, Staphylococcus epidermidis
EANMEERIGLIDIGSNTIRLVIFGYNKKTGLNEILNIKTPARLSQYLTKSNEMNDEGIHVLKETLSSFRKVADKFNVDALYPIATAAIRQSKNREAIIKEIKQDIHIEIQIVPEEDEAFYGYYAITHTTDIENGISVDIGGGSTEVTLFKDKQLKEAHSFPFGVVSLKRQFFGDKAHNDKTAIKNMEQFLREQFSQLDWLSNQHIALVGVGGSARNVARIHQSAHAYPIGGVHNYKMTSKDINNVYDLIRKSSRDELTNLDGLSRDRVDIILPAISVFKTLFKKIDATQFTFSRKGIREGFIMNHISKRYPDEFNKSNVRKDALRHLANEYHIEETSANRRVKLAQSLLNQIISERSLNISAMEKELFIEGSYIYYLGSFIDSDSSSPHTYYLIANSMINGFSHKDRVKLALLASFKNKSLLKFYCKETQWFSNKEIDTIQALGGIIKFANTLNISHTSFVEEVKLKAKKDDKYDLLVYYKGSPIAEEYQANRQKKHIEKILKGKVSIIFTKS

SEQ ID NO: 4491 - protein, 359 aa, Staphylococcus epidermidis
NRSIYMYKLVKPLLFKLDPERAHGLTINALKCVQKCSPILPIVNKLFTYNNPILTQHIHGISFDNPIGLAAGFDKSCEVPKALENIGFGAIELGGITPKPQPGNPKPRMYRLLEDDALINRMGFNNKGMNKALSNLRNHSCSIPVGLNVGVNKTTSYENRYQDYIKVIDTFKNDVSFFTVNISSPNTENLQNFHDEDEFSMLCDALNSFKAKNNINVPIFLKLTSDMELDGFKKILPSITDTFDGVMLANTTRQRDGLNSKNKIQKGGLSGRPLFQRNLQLVKYAYQQTRGNFLIIGTGGIFSSEDAIKMLRNGASLLQIYSSLVIEGPGLTKKMNKEIAHYLTRHGYANVSDIIGLDA

SEQ ID NO: 4492 - protein, 105 aa, Staphylococcus epidermidis
NNFFPKFFHFNELLHNKVTQITVLAYLYNISIKITRILLQFRYKKFILMTIFQHFSEAINSATNFITFIIIVRDKVLIKYIITMLTIHKRNRFPIEKCNTLFIHI

SEQ ID NO: 4493 - protein, 394 aa, Staphylococcus epidermidis
IILMRRHSMEMSERLASIPDSYFGKTMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDKFLEKQNEIFRRRRDNFESQLKHAHLPFVHSKGGIYIWLHTPPGYDSEAFEQLLLKEKSILVAPGKPFGENGNQYVRVSLALDDKQLEEAANRLTQLRYLYER

SEQ ID NO: 4494 - protein, 148 aa, Staphylococcus epidermidis
ITLITIIIAYHSWVIINLLIIYIRLKQRCYIIYERYYDFRRRGMEKSVKLAVGIYLAIILIICSIYLAFILIGSLNGKDMSNSVLDTDHSRINNTSRNSNEDVTSSNNESNNTKAHSFANSEYKAININEAFKNNKQIKKANSSYQYY

SEQ ID NO: 4495 - protein, 247 aa, Staphylococcus epidermidis
FAIMGLKRNRRLRKMYVERKPALYIEDLRDEFKNSLKHFKDDDEAFNTLVGFVELDHLYSSALKEISTKLSILDDNFNYQYKHNPIHHMERRVKEMHSLVKKLNRKGFEVSAQSAKDNIMDIAGIRVVCNYLDDVYVIEKMLLRQEDVKLLKRKDYITHPKENGYRSLHIVVSIPVFLADSVEVTPVEIQIRTIGMDMWASLEHKIRYKNDTDTEKYKGLLEQCASEITNVESKMQQIHSEISNREK

SEQ ID NO: 4496 - protein, 886 aa, Staphylococcus epidermidis
YDIIKNKRWSRMTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICEKYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEESLKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIVSVDGSAGDLYLGAIETVNAEHSEEFDQFMTWSEEIARLQVRMNAETPQDIKAGYNFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRKFNQWEIDYVSCSPFRVPGAILATAQSQAEESER

SEQ ID NO: 4497 - protein, 962 aa, Staphylococcus epidermidis
KRIMIIRSVKMKNALKLFITDLKRVAKTPGVWVILAGLAILPSFYAWFNLWAMWDPYGHTGHIKVAVVNEDQGEKVRGKNINVGNKMVKTLKKNDSFDWQFVSREKADHEIKMGKYYAGIYIPKKFTHEITGTLRKHPQKADIDFKVNQKINAVAAKLTDTGSSFVIDKANKQFNKTVATALLSEANKVGLSIEDNVPTINKIKSAVYQANNSLPKINQFADKIIELNKHQDDLDAYANQFRSLGKYKGNVLDAQEKLNAVNSSIPALNERAKLILALDSYMPNIERILNVAANDVPAQFPRINRGVDIASEGIDAASGQLNDAKGYLTQAKARVGDYQEAAGRAQDVNNQANQNLRNQTSTTPQSAIKSSHSEGKSHSSIKTVPVSQSGENQPVYGDNILSNSDVKSMNTALTEALLSLSNQTDQQAQATQQDIKSLKNIAYGVIASDKPSEFKEPLKNIKSRLENASKYNQQFIDILSELEKSEHVDLSNEIKQVKEANNSINDNLKSTNQLIDALSNGSSGQLEAVNVLRDLPNLNKRLDTLRNYIKKELNRNLLAVSNEITDQLNKGQNTLSTIQSKLNTINRVINAGQDILNSGKKRIDTIQTALPAIENAYINAMRTAQAYFPTAKKDVAKAADFVRNDLPGLERELANVTQSVNQKIPSLFSRYDNAVDLLNEKQPQAKEALASLADFSENKLPDVEKDLKKANKIFKKLDKDDAVDKLIDTLKNDLKKQADIVANPINKKTTDVFPVKDYGSGMTPFYTALSIWVGGLLMVSLLSVDNKHEHLQPIMTKRQVYLGKSGFFFLLGIIQALIVSIGDLVILKASIESPILFVSIAVFSSLVFNSIIYTSVSLLGNPGKAVAIILLVLQIAGGGGTFPIQTTPEFFQAISPYLPFTYSIDALRETVGGIVPEILITKVIILGLFGIGFMVVGYCLKPVTDPIIRKIAEKADESKVTE

SEQ ID NO: 4498 - protein, 69 aa, Staphylococcus epidermidis
TIPIILPLFFADVSIAVSAKTFTIMSEAAAEDKIRPTTIIPKCGAMAIIPFPKIKTINVHNNTDREENR

SEQ ID NO: 4499 - protein, 76 aa, Staphylococcus epidermidis
TRQIVRFISFVETSIIVLVHSITLRLIFKILALNIITITSSIALTCHLFTLILYFNKLNRYTFIRASSYKLCRQAI

SEQ ID NO: 4500 - protein, 82 aa, Staphylococcus epidermidis
TCKIIYNRYHNYWGLETLREGETMIFVMLSPILIILFIVLSVLEEKRRKKNSKEQNSNHVDQQQYDYTDKEQQQNKNSNDDK

SEQ ID NO: 4501 - protein, 402 aa, Staphylococcus epidermidis
GEKMFKKFEYKILYKRIFFTCLILVIYIIGSNISIVSNENLRTHKDSFFKLAITNVGGDLHTLNIFSLGLGPWLSSMIILTLINHKSNDKVKTQTRRERHFKERALTLIISAAQGFYIIHSYINKHAIKDSNMLILLLVLITGTLLMVWLADQNTTYGISGPMPIVLMSLVKSIFNTPFPKLNSSASLITMIIVLLVLDLFILFFIELTEYRIEYNDIMNISAKDIPSYLSWKLNPAGSISIMVSLSLFMLTNNIVNFIGRFIVNHNFETHVFNFTNPVGITIYLLLQMILGYFLSRLLINTKRKSKEFLKNGNYFEGIQPGQQTEKFLGSKARRICWFGSIVVAIVLAIPMYSALLVPHLLKEVYFTTQMIVFVYIGINIAETIRAYLYFDSYKQILNKYW

SEQ ID NO: 4502 - protein, 371 aa, Staphylococcus epidermidis
IVEIAFFRVYDNYGLKIKKEGFGEMDIILGVGTLVLVLIIMTLFLNFAPYGKQGLQALSGAACATFLPQAFLSYAIGGVFHVKFFQEIGDLAGSLSGIAVGILTCLKLEVSPVFAVIVGLVLHDSKLLPAFIAAYVVAFGIKFVEKKVPEGLDLIVVILLAPAVTFGLANLISPGVIAVLKQIGSAITSVGDNNPYALAVILGLVIPVTGMTPLSSMVLTSLLGLTGIPMAIGALTCTGASFVNGILFSKLKIGNKGNAFAVFVEPLTQIDLIAKYPLQLFGANAIIGVVNACIVTYSGLIIDIKGMATPIAGAIVLYGFNDAVRSTITIIAVAIASVILAYVISAIINKFNLMNVGFKLPRRKNQVKESV

SEQ ID NO: 4503 - protein, 152 aa, Staphylococcus epidermidis
NKMIGSELYFSLFVGVVLSLIFAEKFGINPAGLVVPGYLALIFDQPIMLLSVLIISCLTYFIVSNGISKWVILYGRRKFAAMILTGMVIKFIFDLLYPLTPFEMVEVSGIGVVIPGIIANTIQKQGVVITLSTTMLLTCITYIILFLYSFIN

SEQ ID NO: 4504 - protein, 625 aa, Staphylococcus epidermidis
LIVIDRQIKLIKLLLNYTDTYISGHDIAKQLNVSNRTIRNDIKTIHTTFLNELILSVQSKGYMLNTCLYTPDEIQSALESVIVKENKLLITIAYRLFMEKHTFTIKELSSTYHLTKSKVIDYVTRIQTWAIKFDIYLSIKKKQGIMIDASTTSISNAVLHINQLTDDDFKVENLILQELPQAHTRKIKQIISKHIDNHQLSTSENKIQQLLVHLILIIKHSQPEEEDWSTDTESLTIAKKCIKDINETLGYQLNNKTSECFSFFISYHFNKFDLGIQQLFIQSYIDRLIELMEQHIGFPFSQDTILKDNMNVHFSRTYLRLMSHVYLNNPLTSQIKRLYPFVFNTLYDSIRQLSQDTNIQLSEDEIAFLTIHFQSSIERHKSSHIHVVIACYYGLGISTLLAEKIKQLNHAIQIVDTLKLEDINNYHFEGIDLLITTHDFDTSQLLQIPKVIQVSPLFSDEDAKKIEFFVKDMQNPLSKDDILSKIQLSVESNFKMNHSNHILPIFEKSKEILDYHHATLDGYIESAIDREKQSSTYIGKGIALPHGNPEKVLKSHMIIFKPSQPITWKQHEVKLVFFLAMSKKDLNINRKIIQTIAQLEEDDIHQLCLLDDLQLKNTLYARFKE

SEQ ID NO: 4505 - protein, 73 aa, Staphylococcus epidermidis
KGVIIMTQKIIKVEGMSCEHCRNAVESALAKLNGVSSAEVNLDENHVRVEYNDSKVTFENMKEAIEEQGYDVK

SEQ ID NO: 4506 - protein, 121 aa, Staphylococcus epidermidis
IEVINCMENFDKSYHDKTGDVLGALSYLSVFFAPVLFPLIVWIVGQPPASTYSRNALFNHILSWVCLVLGLISFAAGLSLIDSTNGVAVLVIGVIIGGILLIASLVLFIINIVKGIKLLMI

SEQ ID NO: 4507 - protein, 260 aa, Staphylococcus epidermidis
KFQMYSLMWTCLMNLKCLYLMIHLPMYFHLLIHSRLLTLMHFLMSMYLLNLKRLYLMIHLPMYFHCLTHSHSLMWMHFLMWMWTHCLMSTYSLSLKCLYLLSHLTTYLRYRSRSRSLMLMHLLMSTYSLSLKRLYLLSHLMTYLRYWSHSRSLMLMHLLTLTRLLNLKRLCLSTHLTMYFHCLSHSHLLTLTHCRMSMYLLNLKRLCLSIHSMTYLHLLIHSLLLTLMRFLMLTRLLNLKRLCLSSHLRTYLLCLSRLHS

SEQ ID NO: 4508 - protein, 167 aa, Staphylococcus epidermidis
GIEMIRFARLEDLQGILTIYNDAILNTTAVYTYKPQQLDERLQWYQSKAKINEPIWVYEKEGKVVGFATYGSFRQWPAYLYTIEHSIYVHQQYRGLGIASQLLENLIRYAKEQGYRTIVAGIDASNMDSIALHKKFDFSHAGTIKNVGYKFDRWLDLSFYQYDLSDS

SEQ ID NO: 4509 - protein, 134 aa, Staphylococcus epidermidis
LLEMTILIRTFMNSKIHRARVTESNLNYVGSITIDANILDAVDILPNEKVAIVNNNNGARFETYVIAGERGSGKMCLNGAASRLVEVGDVIIIMTYAQLNEDEMVDHSPKVAVLNENNEIIEMINEKENTISNV

SEQ ID NO: 4510 - protein, 530 aa, Staphylococcus epidermidis
MNWISIILFIMVVGGISFYAYLQSRKIKTSSSDGYFMGGNSLTGFTVASTIIMTNLSTEQIVGQNGQSYAQGMEVMAWEVTAAVAVVLLAWVFLPKYLKYGVNTISEFLELRYDTFTKRFVSILFIFTYVVSFLPVVLYSGSLVFNKMFKVDEYLGVSSSTAVIIISSIIGIIGIIYLFIGGLSLSAFSDSIYGMALIIGGLAITILGLGQLGDGNFLHGFDKIVQDTPEKLNGFGKVDSDVVPWPTLFFGMFFNNLFFWCANQMIVQKALAAKNLKESQKGAIYLSLFKVFGPLITVLPGVVAFNYFNGSIDKSDNAYPALVTSVLPEWAFGLFGAVIFGAILSSFVGSLNSTTTLLTLDFYKPIFGKNKSDKHIARVGHIATVVIGVIVVALAPVISLFPSGLYAVVQQFNGVYSMPVLALILVAFFSKRTSKLGAKVTLFTHIILYAIISFVFTEINYLYTFSVLFFVDLIIILIFNKVKPSSEFDLSTHQPKVDMTPWKYRYVAGIIVLALVVVSYIIFSPLVLAK

SEQ ID NO: 4511 - protein, 502 aa, Staphylococcus epidermidis
KVGIKTMIYTVTSTLPLVHGGRTKSLLTRIRFLDKEMGIHNKILTTNYNANYNEVYQKFEENQLITKNTQIENIYDWLSDFKLLSIPKSRFKKKTLYSEKDRDIEGLTSKAFNDGNVMRYYDQETYVLYRKFYEDTNIIEFEDVMSPISKKKIERREYNHFGQLHRKIYFSSRTYHKILEEYFDTEGSIYCKKFFNSQKANELDFIQIFKNQRIMKAFKNEKDLFKYYFEHRFKQNDIVFNDARLLDKPLLNNCMNTKNVLVFHNSHIDGDNIKSSYKIALENSDKVAQYLLLTHMQKDDIQHAYGISDEKISIVPHFIKSYGQKDTHHKEDRFVFIGRLGKQKQVDHLIKSYNQFLKNGHQTKLAIYGADEQNQKQVILDLVKEYQIEDKVDLNDFTKHPLEEFKKSKASLLTSEYEGFGLTVMRSIEVGCPVISYDVRYGPGEIIEHGENGYLVEPDNIEAFAAYMDKIIKNPLKHVKTKETLKYEQAKNNYQKLFERVK

SEQ ID NO: 4512 - protein, 263 aa, Staphylococcus epidermidis
GVVLLSNSKKVAVVTGAAQGIGLKIAERLFEDGYSIALVDFNEAVAKESAEKLSKEGQEAVAFKADVSNRDQVFSVLNQVVEHFGDLNVLVNNAGLGPMTPIESVTPEQFNQVVGVNVGGVFWGIQAAIEQFDKLGHGGKIINATSQAGVEGNAGLSLYSSTKFAVRGLTQVAARDLAEKNITVNAFAPGIVETPMMKGIAEKLAEENNQPMEWGWKQFTDQIALKRLSKPEDVANVVSFLAGSDSDYITGQTIIVDGGMRFH

SEQ ID NO: 4513 - protein, 60 aa, Staphylococcus epidermidis
VLVVVRVLFTVVDFFAIVVFLVDDVLGDIACLVDVALFIDVALDLTDVSLTERLKLDVVF

SEQ ID NO: 4514 - protein, 234 aa, Staphylococcus epidermidis
MTNVLYQHGTLGTLMAGLLEGTASINDLLEHGDLGIATLTGSDGEVIFVDGKAYHANEHKEFIELTGDEMTPYATVTKFKADSSFKTSNKNQEEVFDEVKKQMKSENMFSAVKISGTFKKMHVRMMPGQEPPYTRLIDSARRQPEETRENIKGSIVGFFTPELFHGIGSAGFHIHFANDDRDFGGHILDFEVDDVTVEIQNFETFEQHFPVDAKSFTDADIDYKDIADEIREAE

SEQ ID NO: 4515 - protein, 590 aa, Staphylococcus epidermidis
ERDVNKQRKQINFWRSLTMRRKRDSYDYVIIGGGSAGSVLGARLSEDKDKNVLVLEAGRSDYFWDLFIQMPAALMFPSGNRFYDWEYQTDEEPHMGRRVDHARGKVLGGSSSINGMIYQRGNPMDYEGWAEPEGMDTWDFAHCLPYFKKLETTYGAAPYDKVRGHDGPIKLKRGPATNPLFKSFFNAGVEAGYHKTADVNGYRQEGFGPFDSQVHHGRRMSASRAYLRPALRRRNLDVETRAFVTKLIFDENNSKKVTGVTFKKNGKEHTVHANEVILSGGAFNTPQLLQLSGIGDSEFLKSKGIEPRMHLPGVGENFEDHLEVYIQHKCKQPVSLQPSLDVKRMPFIGLQWIFARKGAAASNHFEGGGFVRSNDDVDYPNLMFHFLPIAVRYDGQKAPVAHGYQVHVGPMYSNSRGSLKIKSKDPFEKPSIVFNYLSTKEDEREWVEAIRVARNILKQKAMDPFNGGEISPGPQVQTDEEILDWVRKDGETALHPSCSAKMGPASDPMAVVDPLTMKVHGMENLRVVDASAMPRTTNGNIHAPVLMLAEKAADIIRGRKPLEPQYVDYYKHGIDDEKAGAMEDDPFYQY

SEQ ID NO: 4516 - protein, 81 aa, Staphylococcus epidermidis
LESVNNMISVNNGVKNKKYKVKHIGISNKNMLYRLGALGLNIGSEISIKQKCLLNGPSVVEVNGQHLSLRQRDARLITLEE

SEQ ID NO: 4517 - protein, 204 aa, Staphylococcus epidermidis
IRSVKMSESNHITWHDSEVTKKQRQHKNGHKSAVIWFTGLSGSGKSTVSVALEKELFNEGKQTYRLDGDNVRHGLNKNLGFSPEDRSENIRRIGEVAKLMVDAGALTVTAFISPYKEDREGVRALLEDNEFIEVYTKCSVEECEKRDPKGLYKKARSGEIPEFTGISAPYQAPENPEITIDTEHDTIEQSVVQIIRYLKEHEYI

SEQ ID NO: 4518 - protein, 304 aa, Staphylococcus epidermidis
ETTVAYKQFIRFAQHHLHFHHLGRHFMVISKKLSLITIGILISILLISLLIDQTISHQFMNQNSIFGTLFQNYGLFPPTLILIISTVILNYYIFTTFQNKLAKILTLLISFIFTLIKTNEFVSETAQYMLSTSANIKNHKPMGMANNEGNAGNALSLGMSFFISLIILIIITFICYQFWLKHTNNQELYHLFKVSLISFMILFIGLELVDSLKHLWGRFRPYEITDKAGHFTHWLTINGNTGHSSFPSGHTGNGAFLMFIAFYFKKLRTQKIVFSIGLCYSILMALSRIRIGAHFTNDYCRFYH

SEQ ID NO: 4519 - protein, 349 aa, Staphylococcus epidermidis
MNNVKESIIVAFAFVGVVVGAGFATGQEIFQFFTSHGIYSIGGIFITGLILTLGGIFVLNTGFRLRSQNHSESIRYYLHPTIAKLFDIILTVFLFSLAIIMTAGGASTINESFGLPFWLSSFILVILILITLFLKFDRLIAVLGGVTPFLVAVVVMIAVYYFITGDLNFSDVSQYSNQNKSISPGWWFDAINYASLQIAAAFSFLTVMGGKLRYQSSTIYGGLIGGIIVTLLLLLINFGLVTEFNQIKEVALPSLLLAKQISPSIGIIMSVIMVLVIYNTVVGLMYAFASRFSRPFTKRYYILIVMMAIITFACTFVGFISLIGKVFPIMGLFGFILLIPVIYKGILRK

SEQ ID NO: 4520 - protein, 68 aa, Staphylococcus epidermidis
TVIVSKMIERQIILDPSKPVNRSIPAEIIGTPRASDVAAPPSKPKINKISTIFPHNLSVCPFKIGRQA

SEQ ID NO: 4521 - protein, 315 aa, Staphylococcus epidermidis
KDKVGEVEMNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSVDAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNLESAIRLANQASSLTVQRKGAQASIPTRKEVEAEYN

SEQ ID NO: 4522 - protein, 1186 aa, Staphylococcus epidermidis
EVKVSDVLIDVDVLDESEMLVLDDSLTDVLSLVDSLSLVDVDALSDVDVLVESETLVLDDSLTDVLSLSDSLTLVDVDALSDVDVDALSDVDVLVESEMLVLVEPLNDVLALSESLSLVDVDALADVDVLVESETLVLVEPLNDVLALLESLTLVDVDALADVDALVESETLVLVDSLNDVLSLFESLSLVDVDALSDVDVLVESETLVLVDSLNDVLALVDSLSLVDVDALSDVDALVESETLVLVESLKDVLALFESLTLIDVDALSDVDVLVESEMLVLVDSLKDVLALSESLSLVDVDPLSDVDVLVESERLVLLESLNDVLVLFEALTLVDVDVLVDSETLVLVESLNDVLALSESLSLVDVDALSDVDILVESERLVLVDSLNDVLALFESLTLVDVDALSDVDALVESETLVLTDSLDDVLALSESLSLVDADALSDVDVLVESETLVLVEPLNDVLVLFDSLTLVDVDALSDVDVLVDSESLVLTDSLDDVLALSESLTLVDVDALSDVDVLVESETLVLNDSLMDVLVLFDSLTLVDVDALSDVDVLVESEMLVLVEPLNDVLALSESLSLVDADALSDVDVLVESETLVLNEPLNDVLALFESLTLVDVDALSDVDVLVESERLVLVEPLKDVLALSESLSLVDVDALSDVDVLVESERLVLVEPLNDVLALSDSLSLVDVDALSDVDALVESETLVLIDSLNDVLSLVESLSLVDVDALSDVDVLVESETLVLNDSLMDVLALSESLTLVDVDALSDVDALVESETLVLVDSLNDVLSLVESLSLVDVDALSDVDVLVESERLVLVDSLNDVLVLSDSLSLVDVDALSDVDVLVESEMLVLNDPLNDVLALFDSLSLVDVDALSDVDALVESETLVLNDSLNDVLSLVESLSLVDVDALSDVDALVEPERLVLVDSLNDVLVLSDSLSLVDVDALSDVDALVEPERLVLVDSLNDVLLLFDSLSLADIDALSDVDVLVESETLVLVDSLNDVLALSDSLSLVDVDALSDVDVLVESETLVLVDLLNDVLALLESLTLVDVDALSDVDVLTDSDNSLLVLADSLAFIDALSDVDVLVESEMLVLVEPLTLVDVDALSDVDTLAESETLVLVDSLNDVLLLVDSLFLADSDALSDVDVLADSDNCLLVLADSLAWIDVLFDVDALNDSERLLLVDND

SEQ ID NO: 4523 - protein, 447 aa, Staphylococcus epidermidis
NIEVKIVRHKLGDSSMLLFIIEIIIMILAILLGLRTAGALGCGIFAIVAQLIMIFGFQLPPGSAPVTAVLIILSIGIAGGTLQATGGIDYLVYIASRVIERFPKSIIFIAPMIVFVFVFGIGTANIALSLEPIIAKTAQKARIQPKRALTASVLTANLALLCSPAASATAYIISVLAGYEISMGKYLSIVLPTALISMLMLSTFCTFVGRKEHVRDESERLVQMPEVEIKNDFSLKVKIGVISFLLCVMGILTFGIFPNLMPQFNVNGDVVKVEMTEIVQFFMYLSATINLLLIKINTSDILSSNITQSAMGALFAVLGPGWLGATIFNAPHNLKILKNDIGSIISEVPWLVIILVSVVAMIVISQTATASIMVPIVMSLGIPPIYFVAMVQTLNVNFVIPAQPTLLFAVELDETGRTRPTSFMIPGFFVITVSVITGFVIKTILGY

SEQ ID NO: 4524 - protein, 280 aa, Staphylococcus epidermidis
VSFLRFEQSRLYKHREDDTMFISKQELYEKLQYVTPRTFAYLNEIDYYNLLMIIEEHQISIPPIHQLRKTLRGSKIMKPKNRVDNCYIHLKDEIPTPINNEQLSFLHFYPRQQIHLILSAYSRMKSLKLQSQKHCLKLKFPLDQHSIRKEITPPQSSDKDNDILICLLQKLINEITKCQVPVSLKNNSFEIKLPNYIIKVDLNYHEQQDHLYPLQYSIHAWHRDFQYLEISNTFTIPSLNDLIFHIQKLFLLIFQLPEHLARQEYSLSQYYFYSQCHTKN

SEQ ID NO: 4525 - protein, 62 aa, Staphylococcus epidermidis
LRKVLISLNFKVFLIIIFHDFLIYYEHGFMYSRFKEHAEQSSHLFILKSHLKPFPPFRYTYD

SEQ ID NO: 4526 - protein, 136 aa, Staphylococcus epidermidis
SVKVMKLKKEINVVGAIIYSDNKILCAQRSENMSLPLKWEFPGGKIENGETEKDALIREIKEEMKCDLIVGDKVTTTTYEYDFGIVNLTTYKCELNNKKPTLTEHKEIKWVGKNELDKLDWAPADVPAVRRIIEEN

SEQ ID NO: 4527 - protein, 69 aa, Staphylococcus epidermidis
IIEVMTMRNAIEELIFSDVSSYDIYVNTGVNQGLVGDIKDGYLTIDSIPYIDAERLYYYSLERKALVTS

SEQ ID NO: 4528 - protein, 333 aa, Staphylococcus epidermidis
IEEVGTFMFKKIATIIGSTLFGTVLFAKVKEKRSYKSFLQEKMIRISGMKKTFESIDDAKKALNETKYQTSGKYNGTTYEFKHKVQIRDYYGSLVYVVNDHGLPDQRTVLYVHGGAWFQDPLENHFEYLDLLVDALDARVIMPVYPKIPHRDYRTTFELLTKIYKRLLTKIDEPENLVIIGDSAGGQIALAFAQMLKKEQLSQPGHIVLISPVLDATFKNPEARKYEKEDPMLGIDGSKYLVELWAGDAPLDDYKMSPMNGDLEGLGHITLTVGTKETLYPDAVKFSHMLNDKGIKHQFIPGYNLFHIYPLFPIPERQHFLEQLKKIIVTKEL

SEQ ID NO: 4529 - protein, 154 aa, Staphylococcus epidermidis
VARVGYHLTWKMILGLFPKEDKVKALDALERVNILDKYDQRSDQLSGGQQQRISIARALCQEPTIILADEPVASLDPLTTKQVMDDLKKINEELGITILINLHFVDLAKEYGSRIIGLRAGELVYDGPASETNDEVFNHIYGRSIKNDEKLGVE

SEQ ID NO: 4530 - protein, 160 aa, Staphylococcus epidermidis
ILLLLLSLNKYIFWEKEMKFKKLLSRIIIATMITFTGTLSYQAIEQTHISHAAHNYYGKKQCTWWAFKRRAQLGKPVSNRWGNAKNWYSNARRSGYATGHKPRKYAVMQSTRGYYGHVAVVEKVYKNGKIKISEYNYNVPLGYGTRIISKSSARNYNYIY

SEQ ID NO: 4531 - protein, 74 aa, Staphylococcus epidermidis
GEILSFYEFMQNFLGDDTPLGELVDWINQDINFPKDVTSQKEILTYFRNHPCPENIPVTSIKRALAVFNQFTKV

SEQ ID NO: 4532 - protein, 85 aa, Staphylococcus epidermidis
LASFSYVSMAAPDNVPLFTASIKSGVFITAPLAALTKTAPFLTFLNILLSNKWKLSLLAGTCNEIISASLIASSTVSLYSKKDKE

SEQ ID NO: 4533 - protein, 122 aa, Staphylococcus epidermidis
EESLMVLRYATNLKLAKELYDASKPKLKGDQGMIDTFTNTFGLPENSVKLAGGVEAAAAGLFAASFLNKNISRLGSLAAISVLGVAAYKHFEAGHGKKGAQHALDLLGLSTLSLLDTFSCKK

SEQ ID NO: 4534 - protein, 66 aa, Staphylococcus epidermidis
SNSLICLACPSVKGLLVTLKFNLIHLLYFVIPIFVIVYICLFLKVINYIFNSSMYHLLFSVNVILN

SEQ ID NO: 4535 - protein, 169 aa, Staphylococcus epidermidis
VNTFALGSEDMETVYFAGGCLWGTQAFFNTIPGVIQTEAGRANGTSKCLDAPYDGYAECVKIHFDPAKTSILMLMDYLFEMINPYSLNQQGQDKGQKYRTGVYSESSKHLNEAKDYIKRREDAKQVMVEVQPLSNYVKSAEEHQNHLEKFPEDYYLCHVPPALLNKYKK

SEQ ID NO: 4536 - protein, 108 aa, Staphylococcus epidermidis
IQTLSWLNIRKVTAQRGENHQKNYKKDNFYIISIEIVFIYLSWTFLSQAHLYIYIVFWMNRMMAITTMTIIETKDKILKCLLFVSLLDSPFSIISCSSRSISRSKSVF

SEQ ID NO: 4537 - protein, 317 aa, Staphylococcus epidermidis
SFQFISPSISFIISNSIMNRKKKGKNKVMTIAIIGPGAVGTTLAFELKKVLPDTELIGRQDKLMTYFPENTSNGSNVKVTSFNHINQTFDVIIIAVKTHQLDDVIKQLPKITHDDSLIILAQNGYGQLNKLPYQHVFQAVVYISGQKVNNNVQHFRDYQLYIQDSTLTRQFKQMVHPSKIEVVLQENIEKSIWYKLLVNLGINTITAIGQQPAKILKSPHIESLCRRILVDGLKVARAEQIDFEDHIVDDILNIYKGYPDEMGTSMYYDVINKHPLEVEAIQGYIYKCAKKHHLETPYLDMAYTFLYAYHLEYTQPD

SEQ ID NO: 4538 - protein, 61 aa, Staphylococcus epidermidis
KRQFLHYFNRNCLYLLILELSVPATLLIITKFLNTMFCYRDVGMFYSFEKRLYVAINKVTD

SEQ ID NO: 4539 - protein, 267 aa, Staphylococcus epidermidis
LFKFLGGYLTMKKIATATIATAGIATFAFAHHDAQAAEQNNDGYNPNDPYSYSYTYTIDAEGNYHYTWKGNWSPDRVNTSYNYNNYNNYNYYGYNNYSNYNNYSNYNNYNNYQSNNTQSQRTTQPTGGLGASYSTSSSNVHVTTTSAPSSNGVSLSNARSASGNLYTSGQCTYYVFDRVGGKIGSTWGNANNWANAAARSGYTVNNSPAKGAILQTSQGAYGHVAYVEGVNSNGSIRVSEMNYGHGAGVVTSRTISASQAASYNYIH

SEQ ID NO: 4540 - protein, 70 aa, Staphylococcus epidermidis
WPKFLGNQNIQVHQTANNRFLKESCYLLGNNISMGTLRQESCDSCLSFIFLGKHLTYSNDNQYKFNKYTI

SEQ ID NO: 4541 - protein, 510 aa, Staphylococcus epidermidis
AITSNITKKGWVLMTNINVRNYIDESYGLFINNEFQASDSGETLTVSNPANGEDLAKVARAGKKDVDKAVQAAHDAFDSWSKISKEERADYLLEISRRIHEKTEHLATVESLQNGKPYRETSTIDVPQAANQFKYFASVLTTDEGSVNEIDQNTMSLVVNEPVGVVGTVVAWNFPILLASWKLGPALAAGNTVVIQPSSSTPLSLIELAKIFQEVLPKGVVNVLTGKGSESGDAIFHHEGVDKLSFTGSTDVGYGVAQAGAERIVPTTLELGGKSANIIFDDANLEQVIEGVQLGILFNQGEVCSAGSRLLVQSSIYNELLPKLKEAFENIKVGDPFDEDTKMSAQTGPEQLDKIESYIKIAEEDDKANILTGGHRITDNGLDKGYFFEPTIIEINDNKHQLAQEEIFGPVVVVEKFDDEQEAIEIANDSEYGLAGGIFTTDIHRALNVAKAMRTGRIWINTYNQIPAGAPFGGYKKSGIGREVYKDAIKNYQQVKNIFIDTSNQTKGLY

SEQ ID NO: 4542 - protein, 147 aa, Staphylococcus epidermidis
ERETYMKYDDFIVGETFKTKSLHITEEEIIQFATTFDPQYMHIDKEKAEQSRFKGIIASGMHTLSISFKLWVEEGKYGEEVVAGTQMNNVKFIKPVYPGNTLYVIAEITNKKSIKKENGLVTVSLSTYNENEEIVFKGEVTALINNS

SEQ ID NO: 4543 - protein, 90 aa, Staphylococcus epidermidis
LVYQNKGVGTVMSDNLSLFIDYINDNIIYGSEIKREKLENLFNQFAIKNVEKNIVYDELKSLDITIIESQDSYKNKLKRLFSVLLQSKKI

SEQ ID NO: 4544 - protein, 256 aa, Staphylococcus epidermidis
KNKNARRGNMLTVYGHRGLPSKAPENTIASFKAASEVEGINWLELDVAITKDEQLIIIHDDYLERTTNMSGEITELNYDEIKDASAGSWFGEKFKDEHLPTFDDVVKIANEYNMNLNVELKGITGPNGLALSKSMVKQVEEQLTNLNQNQEVLISSFNVVLVKLAEEIMPQYNRAVIFHTTSFREDWRTLLDYCNAKIVNTEDAKLTKAKVKMVKEAGYELNVWTVNKPARANQLANWGVDGIFTDNADKMVHLSQ

SEQ ID NO: 4545 - protein, 129 aa, Staphylococcus epidermidis
IQLCNRTVLWNRDVGNIYTGSLYLSLISLLQNHTFQPEEKVCLFSYGSGAVGEIFSGSIVKGYDKALDKEKHLNMLESREQLSVEEYETFFNRFDNQEFDFERELTQDPYSKVYLYSIEDHIRTYKIEK

SEQ ID NO: 4546 - protein, 396 aa, Staphylococcus epidermidis
KSDWDKGDLYKTLVHDKLPKQLKVHIKEDKYSVVGKVATGNYSKVPWISIYDENITKETKDGYYLVYLFHPEGEGIYLSLNQGWSKISDMFPRDKNAAKQRALTLSSELNKYITSNEFNTGRFYYAENKDSSYDLKNDYPSGYSHGSIRFKYYDLNEGFTEEDMLEDLKKFLELFNELASKVTKTSYDSLVNSIDEIQEDSEIEEIRTAQKDKTLKEVEAPKGIIPKYKKGVSKTTKNDSEIEKSNKENKLTGKVGEKLALNYFNELIDNKIDEDKKEQFRNILNDNPGSQHGHGYDLVAFDPTNTDKAVEKFIEIKTSTSSSIEEPFFMSLNEMFAMKEYKQKYLILRIFNVSGKEPQFYFIDPYANYSEFKDVDDLIDKVFNVEAIQYKVFGEK

SEQ ID NO: 4547 - protein, 675 aa, Staphylococcus epidermidis
  UNSURE (18): Identity of amino acid at the above locations are unknown.
SYIRSILMKKIKIVPLIXIVVVVGFGIYFYASKDKEINNTIDAIEDKNFKQVYKDSSYISKSDNGEVEMTERPIKIYNSLGVKDINIQDRKIKKVSKNKKRVDAQYKIKTNYGNIDRNVQFNFVKEDGMWKLDWDHSVIIPGMQKDQSIHIENLKSERGKILDRNNVELANTGTAYEIGIVPKNVSKKDYKAIAKELSISEDYIKQQMDQNWVQDDTFVPLKTVKKMDEYLSDFAKKFHLTTNETESRNYPLGKATSHLLGYVGPINSEELKQKEYKGYKDDAVIGKKGLEKLYDKKLQHEDGYRVTIVDDNSNTIAHTLIEKKKKDGKDIQLTIDAKVQKSIYNNMKNDYGSGTAIHPQTGELLALVSTPSYDVYPFMYGMSNEEYNKLTEDKKEPLLNKFQITTSPGSTQKILTAMIGLNNKTLDDKTSYKIDGKGWQKDKSWGGYNVTRYEVVNGNIDLKQAIESSDNIFFARVALELGSKKFEKGMKKLGVGEDIPSDYPFYNAQISNKNLDNEILLADSGYGQGEILINPVQILSIYSALENNGNINAPHLLKDTKNKVWKKNIISKENINLLTDGMQQVVNKTHKEDIYRSYANLIGKSGTAELKMKQGETGRQIGWFISYDKDNPNMMMAINVKDVQDKGMASYNAKISGKVYDELYENGNKKYDIDE

SEQ ID NO: 4548 - protein, 83 aa, Staphylococcus epidermidis
FFKVYSDMLIFLSYDFVRACLPRGMARAISLSHILFPQASALTKSVVIFIFIRILTEIILIRGIVKAILSKIADKRFVKSSSK

SEQ ID NO: 4549 - protein, 230 aa, Staphylococcus epidermidis
QKGVFCMNYFRYKQFNKDVITVAVGYYLRYTLSYRDISEILRERGVNVHHSTVYRWVQEYAPILYQIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 4550 - protein, 63 aa, Staphylococcus epidermidis
KKYSCLYKRGSLTVPLNTSHLYKISLTSTIISTMIYISKFYYAINTYFPLYLSPMLHNRSNVI

SEQ ID NO: 4551 - protein, 65 aa, Staphylococcus epidermidis
EIDSDFSELDTLPDSDKNSLVDVLFDSISDLLFVLLSDVIELDSDRDELIESFADSDWFKLAVVL

SEQ ID NO: 4552 - protein, 136 aa, Staphylococcus epidermidis
IGGLKMKLAIIKFSVGGLAVLISYIVSVVLPWKEFGGIFATFPAVFLVSMCITGMQFGNEVAMHVSRGAVFGMIGVLCSILATWGLLQATHMWLLSIIGGFVAWFVSALIIFEIVEFIAHKRRDKHGWKTKRSNNQ

SEQ ID NO: 4553 - protein, 89 aa, Staphylococcus epidermidis
RRQSIMFGLIGMIIVGGIIGWIAGLILGKDVPGGILGNIIAGIVGSWVGTMILGEWGPQLGKIHIFPALLGSIILIFIISLILKALRKK

SEQ ID NO: 4554 - protein, 80 aa, Staphylococcus epidermidis
RSTLMTLLTKVLDTLTGICVALLFTKYFVNYANDMFDWHLRWYFLENVPHLALILFILVFIFAVPSEMIKDKNKKKHNDS

SEQ ID NO: 4555 - protein, 184 aa, Staphylococcus epidermidis
FCMFSYQINKNIKLKILEEREAEQLFKLVDSNRDYLAEFLPFVEHTKKVEDSKHFIHSALQQFIDGNGFHCGIWSNKELIGVIGLHYLDLVNKTTSIGYYLAEDFQKKGIMTKCTKALIRYVYEVYDINRIEIRMSTKNKKSRAIPIRLGFTQEGILRSNERLQGEFSDSYVFSLLREECTYTR

SEQ ID NO: 4556 - protein, 108 aa, Staphylococcus epidermidis
KCIPFYFQKSSSSIIKISSTGSPKILAIFIAVNIDGVKSLRSIKDTVCRDIPAFLASSVWLYPSRARNSLSLLRKLYHFLTYKLYNIFVIMTSILVKMTKIIDFLGIV

SEQ ID NO: 4557 - protein, 366 aa, Staphylococcus epidermidis
IMALTAGIVGLPNVGKSTLFNAITKAGALAANYPFATIDPNVGIVEVPDSRLIKLEEMVQPKKTIPTTFEFTDIAGIVKGASKGEGLGNKFLSHIREVDAICQVVRAFDDENVTHVSGRVNPLDDIEVINMELVLADLESVEKRLPKIEKMARQKDKTAEMELRILTQIKEALEDGKPVRSIDFNEDDQKWVNQAQLLTSKKMLYIANVGEDEIGDKDNDKVKAIREYAANEDSEVIVISAKIEEEIATLDDEDKEMFLEDLDIEEPGLDRLIRTTYDLLGLSTYFTAGVQEVRAWTFKQGMTAPQCAGIIHTDFERGFIRAEVTSYEDYVQHGGENGAKEAGRQRLEGKDYIMQDGDIVHFRFNV

SEQ ID NO: 4558 - protein, 380 aa, Staphylococcus epidermidis
IYYTRRIYMNKKLLWSIIGIVIIVVLIIAAFILKQVNGSGSKDSKAYDTYTVRKETPISLEGKASPESVKTYNNNQSVGNFLSVSVQDGQTVKQGERIINYDTNGNKRQQLVNKVNQAQSQVNDDYQKVNQSPNNHQLQVKLTQDQSALNEAQQSLSQYDRQLNDSMNASFDGKINIKNDSDVGEGQPILQLISSNPQINATITEFDINKIKEGDEVDVTVNSTGKKGKGKILKIDELPTSYDTSDDSTASSAQAGAQGDSEEGTEMTTSNPTINQPTGGKSGETSKYKVIIGDLDIPVRSGFSMDAKIPLKTKKLPNNVLTKDNNVFVVDKNNKVHKREIKIERNNGEIIVKKGLKSGDKVLKSPKGNLNDGEKVEVSS

SEQ ID NO: 4559 - protein, 150 aa, Staphylococcus epidermidis
PSPTILNQSVDCSRVLDSAPYMRCNTMPNTIPIAKAVKTRLGNETCFLAIIFNITRKTSNTMTLITVKSISISIYSSFLIFSIPTYVIRIKGVKKKFKLLIYSFQIHLKLNRVKVIIRTMKNEKFMFIRKVSKEDVKRFILIKKTRAIML

SEQ ID NO: 4560 - protein, 99 aa, Staphylococcus epidermidis
TMRTYEIMYIVRPNIEEDAKKALVERFNGILASEGSEVLEEKDWGKRRLAYEINDFKEGFYNIVRIKTDNNKSTDEFQRLAKINDDIIRYIVIREDQDK

SEQ ID NO: 4561 - protein, 71 aa, Staphylococcus epidermidis
IIMTANVVVITMTFEFSEPNLNVRGNIMEKVPAPPMATHSEMNTILKLCVIRPTLGTPASIPTNAHKRKIV

SEQ ID NO: 4562 - protein, 464 aa, Staphylococcus epidermidis
GGETLMDFDTITSISTPMGEGAIGIVRLSGPQAIEIGDILYKGKKKLSEVETHTINYGHIIDPETNETVEEVMVSVLRAPKTFTREDIIEINCHGGILTINRILELTMTYGARMAEPGEYTKRAFLNGRIDLSQAEAVMDFIRSKTDRASKVAMNQIEGRLSDLIKKQRQSILEILAQVEVNIDYPEYDDVEDATTDFLLEQSKRIKEEINQLLETGAQGKIMREGLSTVIVGRPNVGKSSMLNNLIQDNKAIVTEVAGTTRDVLEEYVNVRGVPLRLVDTAGIRDTEDIVEKIGVERSRKALSEADLILFVLNNNEPLTEDDQTLFEVIKNEDVIVIINKTDLEQRLDVSELREMIGDMPLIQTSMLKQEGIDELEIQIKDLFFGGEVQNQDMTYVSNSRHISLLKQARQSIQDAIDAAESGIPMDMVQIDLTRTWEILGEIIGESASDELIDQLFSQFCLGK

SEQ ID NO: 4563 - protein, 89 aa, Staphylococcus epidermidis
ESAAENKLLALASDLNILEITRKIKNTTTTLKIVPMKAPIVVVIRNIFSSIWLLAIDWLSNSSLLVLYVMKALIIANTITMIDLSIHFG

SEQ ID NO: 4564 - protein, 371 aa, Staphylococcus epidermidis
EELAMKDTDLAQIALTQDHTGAIANPIYLSTAYQHPHLGESTGYDYTRTKNPTRTAFEEAFAQLEKGIASFATSSGMAAIQLICNIFKPGDEILVAFDLYGGTFRLFDFYEKQYGLKFKYVDFLNYEEVEKNITPQTRALFIEPISNPQMIEIDVEPYYILSKKHQLLTIIDNTFLTPYLSTPLEEGADIVLHSATKYIGGHNDVLAGVVTVKDAQLAEQLNQFHNMIGATLSPLDSYLLQRGLKTLHLRIERSQENAQKLAQRCRQSDSIDEVLYSGRTGMLSLRLNQAYSVAKFLENLEICIFAESLGGTETFITFPYTQTHVDMPDEEKDKRGIDEYLIRLSVGIEDYNDIEADIIQALENSKVGVIS

SEQ ID NO: 4565 - protein, 254 aa, Staphylococcus epidermidis
RYLYYGGGRLLKIKRYALLCLLGGLVGGIIGYIIGAINWEKLFNYAQFANFKVVLYTTIVASLINVILTVYLFIVQNASLHYKAKIDANISDDLADTYENKSYIKSLKVRFIYTMQLIVAFIAILIPVIGNSSENHIALIMIPFFITIISSIMIGIFYRKFDARYPKLGEKHYTEKAFNIMDEGERYITLVSLYKVHQQNIVLLFIGIMMLGIFSITTGMNQSLGIILFIILFIYNSLGYLLKVSNFYKSEQKS

SEQ ID NO: 4566 - protein, 66 aa, Staphylococcus epidermidis
LTFLPLCFKLLISAIKVKATGLSIPIANPIIQRHIIRIITFGASAAPREVTVSVSKAIDKIRLRPN

SEQ ID NO: 4567 - protein, 399 aa, Staphylococcus epidermidis
GDEYDMSRIVLAEAYRTPIGVFGGVFKDIPAYELGATVIRQILEHSQIDPNEINEVILGNVLQAGQGQNPARIAAIHGGVPEAVPSFTVNKVCGSGLKAIQLAYQSIVAGDNEIVIAGGMESMSQSPMLLKNSRFGFKMGNQTLEDSMIADGLTDKFNDYHMGITAENLVEQYQISRKEQDQFAFDSQQKASRAQQAGVFDAEIVPVEVPQRKGDPLIISQDEGIRPQTTIDKLAQLRPAFKKDGSVTAGNASGINDGAAAMLVMTEDKAKALGLQPIAVLDSFGASGVAPSIMGIGPVEAIHKALKRSNKVINDVDIFELNEAFAAQSIAVNRELQLPQDKVNVNGGAIALGHPIGASGARTLVSLLHQLSDAKPTGVASLCIGGGQGIATVVSKYEV

SEQ ID NO: 4568 - protein, 690 aa, Staphylococcus epidermidis
GKNLIEVISLTNNNRIKRFSIRKYAVGVVSIITGVTIFIGGQQAQAAETSVQHADAHPEDSQTTQQLKNDKVEETLKASKQGNADSQQVQTIDQSKTNQNNQHSVAESAQLKSDETANQPKKEESSSVKQDVQPSKNVNQQDAATQSNERENNDIKGEGQTSKTSNQHIQSSNSHNQSTGTKDSDSEEIDQPLVKLQKPSNDSTYQTQSKTKQDSSKQLPQEKTTKRQIQTTENEQTTKVDSKKANDTQNVEKHTQEPKNDTSTSQKNHHQVATKEQSNRSTTRKTQKQSSNANQNHQFTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 4569 - protein, 298 aa, Staphylococcus epidermidis
LILHFSYNNIKIIFHIIALNIKFIIKESFMLKKFSYSIISLSIFATSLNFIDTQAQASSSSVSEKGTMGYGYQQYLKDHPKKQTHKTQNRSTFSAESNITETNNGERVLDISEWQGLLTNEQIKQLKKNYDFIILRAQYGSEYVDKTFEKNAELLEQNKMKYGVYSYSMYESPKDARYEAKTLSQRAPKAAFYINDYEEQTVKSGDDETATQAWANEMRKLAGNKKILFYSYENFMLNHASNAVSSYDGYWLAAYQAEEPKREKVLWQYTDSYYSPELNQNVDANYIDENVNSSWFTS

SEQ ID NO: 4570 - protein, 508 aa, Staphylococcus epidermidis
NMLNADLKQQLQQLLELMEGDVEFVASLGSDDKSNELKELLNEIAEMSAHITITEKSLKRTPSFSVNRPGEETGITFAGIPLGHEFNSLVLAILQVSGRAPKEKQSIIDQIKGLEGPFHFETFVSLTCQKCPDVVQALNLMSVINPNITHTMIDGAVFREESENIMAVPAVFLDGQEFGNGRMTVQDILTKLGSTQDASEFNDKDPYDVLIVGGGPASGSAAIYTARKGLRTGIVADRIGGQVNDTAGIENFITVKETTGSEFSSNLAEHIAQYDIDTMTGIRATNIEKTDSAIRVTLENDAVLESKTVIISTGASWRKLNIPGEDRLINKGVAFCPHCDGPLFENKDVAVIGGGNSGVEATIDLAGIVKHVTLFEYASELKADSVLQERLRSLPNVDIKTSAKTTEVIGDDYVTGISYEDMTTGESQVVNLDGIFVQIGLVPNTSWLQNAVELNERGEVMINRDNATNVPGIFAAGDVTDQKNKQIIISMGAGANAALNAFDYIIRN

SEQ ID NO: 4571 - protein, 399 aa, Staphylococcus epidermidis
HVNNFSNVISVAIRSILKNKRRNIFTMIGIIIGIASVITIMSLGNGFKKSTTEQFNDAGAGKNQASISYMTENMEAPKNNPFKQEDMSVVEQVNGVKSAKVKEDKDSTYSVKITNTHGSSDASLKKVDKLTDVDEGKGFTNDDNEVLEKVAVIDKKIAKKVFNNHAMGQSIYINGEGFKVVGVSDSSEVDESGMPIESLIQIPTKSFNKYMGNLTQGMPQLLVTVEKGSDKKDVGKKVEKALNKKGTGVSEGQYSYEDNEAVMKTIGSVLDTITYFVSAVAGISLFIAGIGVMNVMYISVTERTEEIAIRRAFGAKGRDIEIQFLVESVVLCLIGGIIGLILGIIIATLIDLVTPEMVKSSVSLGSVILAVGVSTLIGIIFGWIPARSASKKELIDIIK

SEQ ID NO: 4572 - protein, 200 aa, Staphylococcus epidermidis
KHIKGAIIMKKEIIEWIVAIIVAIVIVTLVQKFLFASYTVKGASMHPTFENREKVIVSRIAKTLDHIDTGDVVIFHANAKQDYIKRLIGKPGDSVEYKKDQLYLNGKKVDEPYLSENKKHKVGEYLTENFKSKDLKGTNGNMKIPSGKYLVLGDNRQNSIDSRMDEVGLLDKNQVVGKVVLRYWPFNRWGGSFNPGTFPN

SEQ ID NO: 4573 - protein, 94 aa, Staphylococcus epidermidis
KYLKQVFYMQHKNKFQRINQIIQVIGFLSFLAILTIITLNFFIKGHLQGHFEIGFNIQSNQVYVVTTLIIVTIICTILSAILNMLSNKKQNYKH

SEQ ID NO: 4574 - protein, 61 aa, Staphylococcus epidermidis
EFKKKEVRFSYTNLELLYKHSLLNLNLCSSFLSKRPTAFELNFELLVELSINSYINVSNQL

SEQ ID NO: 4575 - protein, 281 aa, Staphylococcus epidermidis
IMENLLEVQQLNKSYKNSEFQLTDITFSVKPGEVVGLIGKNGSGKSTLINTLVGNRHKDNGSLKFFDKEVTENDFKYKEHLGVVFDDLRVPDKLTLQYINKVFTEIYDAWNSDTFFSLIKAFELPTNNQIKTFSRGMRMKAALTIALSHDAKLLILDEATAGMDVSGREHVLEILEDYLGDDRAILISSHISEDIEQLATQLVFMRDGRIILKESKEVLLSQYGIIDQPVEHFNISNEYLIATRRRNDRQISLVNNYQKVPDAQPLKTIDDATKIIMRGEV

SEQ ID NO: 4576 - protein, 214 aa, Staphylococcus epidermidis
SIMKGLTLSIFYTAKKSFFIYLVVGIIAAVVFSFLNPTMNSFLAIIFLISPITDNFKREKDSRWMNYISTLPVRRADYVKSYYTIFLLCALVGILAGVPSVGLITQSLSMVFISLCVAIGGAGTFSIMFPLTFKFGSENSNVIVMTTTFAVIIIYFLFYIASMILSNQTGSGSMITMLSNTQSYVVYSIYGILGLISIIISYILSIKIFNKQEL

SEQ ID NO: 4577 - protein, 161 aa, Staphylococcus epidermidis
QLVKLKSASLPTIQNSQEVIQSAQEQQSKDIAKANELKDSELRSHFDSMSNSASISQSNVASQSTTASLNQSESANDSMSSSLSESNSITSESNTNSKSEIESKSTSTSEFLSESGSVSNSEKSESISHSQSTSATPSSQSTYQQQPKEEKKGFFARLFNL

SEQ ID NO: 4578 - protein, 304 aa, Staphylococcus epidermidis
MNYEKNEREGIFYMNQLKHILSSLFEPLTKVETYENLITKVIMILIYILVAIVVIAILNKIIEQAFKIQNKSKKGNKKRSKTLISLVQNIVKYIVWFVVITTILSKFGISVEGIIASAGVVGIAVGFGAQTIVKDIITGFFIIFENQFDVGDYVKINSSGTTVAEGTVKSIGLRSTRINTISGELTILPNGSMGEITNFSITNGTAIVELPVSVDENIDQVEKKLNRLFVSLRSKYYLFVSDPVVDGIDAIESNKVTIRISAETIPGEGFSGARIIRKEAQKMFRQEGIRMPQPVISNYNEEKS

SEQ ID NO: 4579 - protein, 70 aa, Staphylococcus epidermidis
NTYEVFFMRLNLDWNKDFQEFQDILNSGIHPEWLYCAKANLVLEPAYTGEGKQFFSTQDIIKASKIIPFF

SEQ ID NO: 4580 - protein, 396 aa, Staphylococcus epidermidis
SRSDFMSLSKETEVIFDVRRGNDYDSANPPLYDSSTFHQKVLGGETQYDYARSGNPNRTLLEEKLARLEGGKYGFAYASGIAAISAVLLTLNAGDHVILPDDVYGGTFRLTEQILNRFNIEFTTVNATHIDHITEAIQSNTKLIYVETPSNPLFKITDIHAVATLAKEHKILLAVDNTFMTPLGQSPLALGADIVIHSATKFLGGHSDLIAGAAITNNREVANALYLLQNGTGTALSAYDSWALAKHLKTLPVRFKQSVHNAERLVQFLSQREEISEVYYPGNNLTHLKQASTGGAVIGFRLKDESKAQKFVDSLTLPLVSVSLGGVETILSHPATMSHAAVPEDVRRERGITFGLFRLSVGLENSEELIADFNYALKEAFNESFTEPIKEQRFSS

SEQ ID NO: 4581 - protein, 219 aa, Staphylococcus epidermidis
KKGDKMKQLLFKTSCVIMVLLTSSLSIVSTYSHATTSGGTSSSSLASSSSSSSAASASRGSTSSSTSMSRSSAINASRNAQQSSQRAAQQATKSSRVTATKNKGQQSVSRQKAQSRSLMPSQRPYDSSAPYSSQYIATTYYNNWLFYYIFAHSFLNQHEKKNSVDAQFNMLKQQMKPHEKLYTVTVKTKQGKRVVVVPKKQYDKIEKGKHIKVKNGVVQ

SEQ ID NO: 4582 - protein, 254 aa, Staphylococcus epidermidis
YELEVRQMSQYPLWNQLNTLKEAQWVDLTHTFDPNIPRFSEFEKGEVSTLFNVKDHGFYVQRWSIVTQYGTHIDAPIHFVENRRYLEELDLKELVLPLIVLDYSKEAAQNSDFIVSRKHLEDWEQQHGRIEAGTFVALRTDWSKRWPDIEKFENKDVDGHQHLPGWGLDALKFLIEERGVKSIGHETFDTDASIDTAKNGDIVGERYILGQDTFQVELLTNLDQLPTRGAIIYAISPKPKDAPGFPVRAFAIKP

SEQ ID NO: 4583 - protein, 289 aa, Staphylococcus epidermidis
IKIERCGKEMAYTDDQRLKMNNDDSVQFIELELIRPNPYQPRKTFEEERLNDLASSIQQHGILQPIVLRQTVQGYYIVVGERRFRASKLAGLTEVPAIIKELSDEDMMELAIIENLQREDLNAIEEAESYKKMMTDLNITQQEVARRLGKSRPYIANMLRLLQLPKNVAQMVQHGALSSAHGRTLLTLKDASKIKKTAKQAAQESWSVRYLEEYVNGLVSKDISRKVDKETKESKPKMIQQQERFLKKQYGAKVDISTSKNVGKITFEFKSEAEFKRLIRQLNKDYKEY

SEQ ID NO: 4584 - protein, 186 aa, Staphylococcus epidermidis
HIKEGINMAGRPKDPTINKKIYTEIQRLLETTHFRDITIDQISENTGISKATIYRRWKDKSSIIMSAFIEQSQYIVIHNQDNLYDDLFQFLVKIKDIYKTKLGSAVIEILISHQQMEARETFMTNYFNHNRKVLKEIVRKHIQEEEQDLFIDLIFSPIYFNILIKPETLDKNYIKKMLNQVLRIYH

SEQ ID NO: 4585 - protein, 117 aa, Staphylococcus epidermidis
CLMEKAYRIKRNSDFQAIYKNGKSVANRQFVVYTYKNRDLKHFRLGISVSKKLGNAVTRNRIKRAIRENFKVHKQNIIAKDIIVIARQPAKDMNTLEIQSSLEHVLKIAKVFNKKIK

SEQ ID NO: 4586 - protein, 216 aa, Staphylococcus epidermidis
YVKEIYYMSTQELKENDIQNSSIPFVNHFNKLRHQPKWILKSIIVIVLAIISAFITYNTSNELLDNQSIANSQMDENMLRMTTTIGAFIGTIFSVVVVFLIFLVISKIFKSDAKASSLFSAALSYSIIILGFTIIISLIQIVFGLKITDYKLDSLNIFSKDNKTLMAFSLTNLLKAFLTGVVYYSTSRLSKKTSMILGIIALIILIGSGMLGGMNG

SEQ ID NO: 4587 - protein, 213 aa, Staphylococcus epidermidis
KELLNSMKKRVITYLILALSLTLAACSNTNDNNNQEHHSNAHAPKNAKTLKEKDIFSSNKKGQKISEKEMKQALEKYLQANSDVLDNKYVMQHKLDKQSDSNPKITESQADRLSKLSNLAVKNDLHFKKFIKNNHIPEEYKDPTDRIINYFHALNSTISNVDADIEKLNYQPQNSINVVDVPTKYSGDVNKKQQDKITTFLKKKGIDTEVFNK

SEQ ID NO: 4588 - protein, 758 aa, Staphylococcus epidermidis
INHCQQGGNIMTTIKTSNLGFPRLGRKREWKKAIENYWAHKIDKAELDQTLTDLHKENLLLQKNYHLDSIPVGDFSLYDHILETSLLFNIIPERFQGREVNDDLLFDIARGNKEHVASALIKWFNTNYHYIVPEWDNVEPKVEKNTLLERFKYAQSINVNAHPVIVGPITFVKLSKGGHQSFEEKVETLLPLYKEVLQSLVDAGAKYIQIDEPILVTDDSESYEDITRKAYDYFANEGLGKYLVIQTYFERVHLKFLSSLPVGGLGLDLVHDNGYNLKQIEDGDFDQSKALYAGIIDGRNVWAADIEAKKQLIETLQQHTQQLVIQPSSSLLHVPVSLDDETLDESIAEGLSFATEKLDELDALRRLFNDNDLSKYEHYKARYERFQSQSFKNLEYDFESVPTHRKSPFAKRKQLQNQRLNLPDLPTTTIGSFPQTREVRKFRADWKNNRITDAEYQEFLQNEIARWIKIQEDIGLDVLVHGEFERNDMVEFFGEKLQGFLVTKFGWVQSYGSRAVKPPVIYGDVKWTAPLTVKETVYAQSLTDKPVKGMLTGPVTILNWSFERVDVPRKVVQDQIALAIDEEVLALEEAGIKVIQVDEPALREGLPLRSEYHEQYLEDAVHSFKLATSSVHDETQIHTHMCYSQFGQIIHAIHDLDADVISIETSRSHGDLIQDFEDINYDLGIGLGVYDIHSPRIPTEEEITTAINRSLQQIDRSLFWVNPDCGLKTRKEDEVKDALTVLVNAVKKKRQESESTTA

SEQ ID NO: 4589 - protein, 127 aa, Staphylococcus epidermidis
SSLCLNCAAILFWLILKSSGEVISKVVLVLDCVIAAKQRILTVKAEMIAITVRDIAFFFILCMIDDVKTTSVIFTRPCLICFSVLKISDTELLKNKKAPTIVKKSMLKGVIKAVVKALKTPNISVDI

SEQ ID NO: 4590 - protein, 169 aa, Staphylococcus epidermidis
MLNRVVLVGRLTKDPEYRTTPSGVSVATFTLAVNRTFTNAQGEREADFINCVVFRRQAENVNNYLSKGSLAGVDGRIQSRSYENQEGRRIFVTEVVCDSVQFLEPKNAQHGGQRSQNNNFQDYGQGFGGQQSGQNTSYNNNNSSNSNQSDNPFANANGPIDISDDDLPF

SEQ ID NO: 4591 - protein, 60 aa, Staphylococcus epidermidis
NIIRLSNITALSLSDAIQVFFAMVKMLLGTFNMIINVDICYLDILLHRIFYRYTIKDNAL

SEQ ID NO: 4592 - protein, 69 aa, Staphylococcus epidermidis
YNLRNRLKELRARDGYNQTELAKKAGISRQTVSLIERNDFTPSILTAIKIARIFGEPVEDIFIMEEEDF

SEQ ID NO: 4593 - protein, 78 aa, Staphylococcus epidermidis
RKKLIIIGGHFMTSKYGINDIVEMKKPHACGTNRFKIIRMGADIRIKCEHCQRSVMIPRQVFNKKMKKVLESHQDKES

SEQ ID NO: 4594 - protein, 80 aa, Staphylococcus epidermidis
SLLRKKVMHLMMIDHNGIFLCKFGNIMWNVFTAIKVCNTHLNTMKVRDKLLNNRFEYPNIMTIRKEGLLLPSFLEKYKLY

SEQ ID NO: 4595 - protein, 236 aa, Staphylococcus epidermidis
WRKSRGVIMIELRKINRHFKNGNESNHILKDIDIHIDEGEFIAIMGPSGSGKSTLINILGFIDRGYEGEYFFNNENYQKSSDNKLAEIRNHTVGFVFQNFKLIQNNTILENVSIPLIYNGLSNKARKSKVLDGLHDVGLKGKENLLPNKLSGGQQQRVAIARAIINDPKFIIADEPTGALDSKTSQDIMELFVKLNKEQNTTIIMVTHDREVAEKADRIIHILDGRVQEEEVLTRE

SEQ ID NO: 4596 - protein, 133 aa, Staphylococcus epidermidis
MEKRSINMKKVFMIISILTITVTLSACGGSGKQKEPSKESQKSDKYDYVYYEILNDGDSETPNVEIKYKDKKGKSHIEKADLDHVYEHILGDGNKKPYIVKDGKKIHVYRPPYMIYGDDDVEGKAVSKDEVTK

SEQ ID NO: 4597 - protein, 90 aa, Staphylococcus epidermidis
NKMSQRRQLTMAGGPRRGGRRRKKVCYFTANGITHIDYKDTELLKRFISERGKILPRRVTGTSAKYQRMLTTAIKRARHMALLPYVKEEQ

SEQ ID NO: 4598 - protein, 132 aa, Staphylococcus epidermidis
KEMRKIIMKIRLTFIILAILSTIGLVLVLAKYPTGPHTINYNEPYTVLIAITTIVIMALPALILGIFNHLACRIISAILQISALMMWGFLVIISLIMGQIVIMLMASLTILALLVSSIVTLSVHPSTSDKIN

SEQ ID NO: 4599 - protein, 126 aa, Staphylococcus epidermidis
IWMRRVIVFGISISSAILHFVIGGFAVALASIMADKVGGKLGGIIATMPAVYLAAIIALAIDHKGQQLIQMSIHLSTGAIVGIVSCIVTVFFTSIFIGKKNYRSGTVFAILCWFVISVAIFLVRHI

SEQ ID NO: 4600 - protein, 256 aa, Staphylococcus epidermidis
RSERMAILTANQLSKVYGHKQKYRALNNISFSVEKGEFVAVMGPSGSGKTTLLNVLSSIDTISGGTVEVEGKEINKLSHKEVANFRKQHLGFIFQDYSVLPTLTVKENIMLPLSVQKFHKYEMEQNYKEVAEALGIYNLGNKYPSEISGGQQQRTAAARAFVHKPTIIFADEPTGALDSKSAQDLLHRLEDMNKQFNSTIMMVTHDPSAASYAERVIMLKDGDIHSEIYQGNDSKQTFYQEIMKLQTALGGVSHDI

SEQ ID NO: 4601 - protein, 196 aa, Staphylococcus epidermidis
LFRRNLSMSLINKEILPFTAQAYDPKKDEFKEVTQEDFKGSWNVVCFYPADFSFVCPTELEDLQNQYAKLQELGVNVYSVSTDTHFVHKAWHDHSDAISKLEYSMIGDPSQTITRNFDVLDEESGLAQRGTFIIDPDGVVQAAEINADGIGRDASTLVNKIKAAQYVRQHPGEVCPAKWEEGSESLQPGLDLVGKI

SEQ ID NO: 4602 - protein, 286 aa, Staphylococcus epidermidis
LRGREWIMKKPFSKLFGLKNKDDIIGYTEEERNNNVESIHIERIVPNRYQPRQVFEPNKIKELAESIEEHGLLQPIVVRPIEEDMFEIIAGERRFRALQSLHKPQVDVIVRDMDDEETAVVALIENIQRENLSVVEEAEAYKKLLEIGGTTQNELAKSLGKSQSFIANKLRLLKLAPNVIKRLREGKITERHARAVLVLPDKTQEELIEQVISQKLNVKQTEDRVRQKTGPEKVKAQTFQFSQDVTQAKEELGKSIETIEKSGIRVEQKDKEHEDYYEIKIKIYKK

SEQ ID NO: 4603 - protein, 78 aa, Staphylococcus epidermidis
TFNGNAPALEREVNAKISTSIVFFTYLTGLIPKTLSIIKWIIYIVIRAAYEAIKNLPNVQIAEKSLVARVEAIIAKMP

SEQ ID NO: 4604 - protein, 258 aa, Staphylococcus epidermidis
ILIGVGIVSDYVYELMKQHHSVRKFKNQPLGSETVEKLVEAGQSASTSSYLQTYSIIGVEDPSIKARLKEVSGQPYVLDNGYLFVFVLDYYRHHLVDEVAASNMETSYGSAEGLLVGTIDVALVAQNMAVAAEDMGYGIVYLGSLRNDVARVREILNLPDYTFPLFGMAVGEPSDEENGSPKPRLPFKHIFHKDQYDANQHQQRKELEAYDQVVSEYYKERTNGVRTENWSQQIETFLGRKTRLDMLDELKKAGFIQR

SEQ ID NO: 4605 - protein, 631 aa, Staphylococcus epidermidis
LLGGKRVVQEYDVVVIGAGHAGIEAGLASARRGAKTLMLTINLDNIAFMPCNPSVGGPAKGIVVREIDALGGQMAKTIDKTHIQMRMLNTGKGPAVRALRAQADKVLYQQEMKRVLENEDNLDIMQGMVDELIIEDNEVKGVRTNIGTEYRSKAVIITTGTFLRGEIILGNLKYSSGPNHQLPSVTLADNLRKLGFDIVRFKTGTPPRVNARTIDYSKTEIQPGDDIGRAFSFETTEFILNQLPCWLTYTNGDTHQVIDDNLHLSAMYSGMIKGTGPRYCPSIEDKFVRFNDKPRHQLFLEPEGRNTNEVYVQGLSTSLPEHVQRQMLETIPGLEKADMMRAGYAIEYDAIVPTQLWPTLETKAIKNLYTAGQINGTSGYEEAAGQGIMAGINAAGNVLGTGEKILSRSDAYIGVLIDDLVTKGTNEPYRLLTSRAEYRLLLRHDNADLRLTDMGYELGLISEERYARFNEKRQQIKDEIQRLTDVRIKPNEHTQAIIEAKGGSRLKDGILAIDLLRRPEMNYETILEILEESHQLPEAVEEQVEIQTKYEGYINKSLQQVEKVKRMEAKKIPEDLDYSKVDSLASEAREKLAEVKPLNIAQASRISGVNPADISILLVYLEQGKLQRVKQ

SEQ ID NO: 4606 - protein, 246 aa, Staphylococcus epidermidis
TSKGETIMSIEWLSEKLSEQGIELSNTQKEQFQKYYKLLVEWNKKMNLTSITDEHDVYLKHFYDSIAPSFYYDFNGQLSLCDIGAGAGFPSIPLKIVYPELKVTIVDSLNKRIQFLNHLAAELGLEDVSFVHDRAEIYGKGVYRESYDIVTARAVARLTVLSELCLPLVKKGGQFLALKSSKGEEELQEATFAINILGGNVKETHTFELPENAGERQMIIIDKRRQTSKKYPRKPGTPNKSPLVES

SEQ ID NO: 4607 - protein, 199 aa, Staphylococcus epidermidis
FQIIIKEFKAMNVSNQIKKFRERDGYSQEFLAEKMFVSRQTISNWENDKSYPDIHNLLIMCQLFKVSLDELVEDDLKNVQIKNIKKELDFWTWMMIITMVLGSVLIGPMIHYFHWLGIGITYLVFLIGIIASTKLEKIKIKNDIETYDRILAFINGKDPKEVQKSKFRDIWTSSISFIFFVGVIIGISYLSIILTDYFL

SEQ ID NO: 4608 - protein, 224 aa, Staphylococcus epidermidis
YVIMNCKTTSRRFLMDGLITFIIITLLIIIVPGPDFIIVMKNTINSSKMNGFMAAFGITTGHILYSSLAIFGIIYILTSLHFVFLTIKILGACYLIYLGIKSILSAHSSVDFSKQALADVRNVSYITSFRQGFLSTSLNPKALLFYVSIFPQFLSNGNIHMKSEVALFAFSVVVVICLWFLFCVFIFQYIKLLFSRPRFKAIFDYIVGFVLIGLSINLLLSKSS

SEQ ID NO: 4609 - protein, 199 aa, Staphylococcus epidermidis
GDRMEIYLVRHGESQSNYDNKHGYLYFCGQLDVPLTERGIKSAKELSVYFKNKYIDNVYVSDLKRTRQTYEELFPYDIPTIYTKTLRERSLGVFEGKNKEEVCKDKRFEKYFRDPNYKYFRHSFSQKAPQGESYQDVYDRVVTFIENELNQQQRRVVIVAHQVVIRCFFVYFKMITKEKALTTEIHNCYPYLIKEEMKF

SEQ ID NO: 4610 - protein, 470 aa, Staphylococcus epidermidis
RPWITIEKKMKIRDENMNFVKSKTDLFRLIDNEAQTSTSKVVLFLILGTIFLDAYDITILGTMTDQLTQQFHLSPATLSIVMTSLPIGALFGALLGGTLAYQFGRKRILSIALLTLTVTSLGAALAPNVIILIICRCIMGFAIGMDSPVAFTFIAEISNLKHKGRNVNYWQVVWYVAIVTSALVVTAFFMLGAGAHLWRYAVGFGALIAFVLYILRIKYLHESPTWVINHYSLEKATEFIRKYYHKDIHLEGTLEDDLNSDVTSPHNSWTDLFKPRYIKRIILATAISTLQGMQYYGVGLYIPIIATYLISKDKIGVLLGTAIVNIAGILGAYLGAQLTYKLGTRKLTMIGFTLVLLSMVCVGLFYHHLPMLLNTFLIGLFLFGHSGGPGTQGKTIGALSFPTHLRSQATGFVESVSRTGSIIGTFVFPIILAAVGLTNTMLILSIVPLLGIIITVSIKWEAVGKHIEVE

SEQ ID NO: 4611 - protein, 68 aa, Staphylococcus epidermidis
RTVFIMKFKELIKQSYEDLKNLTVNWFNVLSLTVIIFILSNIVTPLIGISVGLLGGAYILKRREEKNK

SEQ ID NO: 4612 - protein, 491 aa, Staphylococcus epidermidis
INNLNFFLTPFILITYVGILKIKKELYIDMEILFTVINVIVLLVFLVMLNIMARKHVSFPKRVFTALAIGIVFGIVLHLIYGAESKTLEQSTDWFSIVGDGYVALLQMIVMPLIFISIVAAFSKIQIGEKFAKIGSYIFMFLIGTVAIAAIVGIFYALIFGLDASSIDLGSAEHSRGTEISKQAKDLTANTLPQQILEVFPSNPFLDFTGQRTTSTIAVVIFATFVGFAYLRVARKQPEHGSLLKRGIEAIYSIVMAIVTFVLRLTPYGILAIMASTLATSDFSAIWTLGKFLIASYAALITMYIIHLIILSVLGINPVKYVKKTIEVLIFAFTSRSSAGALPLNVQTQTKRLGVPEGIANFSATFGLSIGQNGCAGIYPAMLAVMVAPVANVEIDFQFVVTLIAVVIISSFGVAGVGGGATFASILVLSTLNLPVALAGVLISIEPLIDMGRTALNVNDSMLAGTGTARLTNHWDKKTFDSNDYGDLSAN

SEQ ID NO: 4613 - protein, 85 aa, Staphylococcus epidermidis
NPLVHIFNDIRTKGFFNAYSTSICLPTASHFIDTVMIIPSKGTMDKINIVFVRPTAARMIGKTKVPMILPVRLTDSTKPVACERK

SEQ ID NO: 4614 - protein, 169 aa, Staphylococcus epidermidis
WVFLVIPSIYERSNMMSNITVYNVIELGVNNLLADYDNWNVEEVLDKETQHFPNTLHWQYGHVLTIFEQALSLGNQHVVDVEKYNKLFGYGSNPRDWKGQDVPAINEIKQHIQTLPERAKKLTHEQLAQKLDQPIAGCNTLDELLMLNAIHVPLHTGKIEEMTRVLREK

SEQ ID NO: 4615 - protein, 630 aa, Staphylococcus epidermidis
VVSVMTFNQLILKNLRKNIKHYGMFLFSLLISIILYFSFSTLKYSNSINNSDSSTIIKNGATIGATILFIIIVVFLMYANHLFIKRRTKEFALYQLIGLTRGNILRMLNIEQLVFFIVTGILGTLIGIFGSKLLLVIASKLMKLNTHISIGFEPQAILITIVMLAVAFLLIMIQNYIFLKKHSILALMKDNYTPEATQKRITTFEAIGGILGIIMIVFGYYMSTEMFGVFKALTTALITPFSILFLTIVGAFLFFRSSVSLIFKTLKHIKHGRVNITDVVFTSSIMHRMKKNAMSLTVIAIISAFTVSILCFAAITQSNTNTTLEMTSPDDFNISQNKIAAQFKHKLDQENLKYHQRTYEVINPKTLSDHVMKSKNGSDMSTNTTSLMMNSHLKGHEAKITNIQSSTGLIDIHLNHKITVKGKSKQSIIVKDKDNSKIYPSQLSFGAPIVEVSPEVYNTLKTDNIVNKMYGFNFNTHKDVKKAEKIASKVNRNIVSHDEYKKFINQSNGILIFVTSFLGIAFLMAAGCIIYIKQMDETEDELDNFKILRRIGFTYTDMSKGLLLKIAFNFGLPLLIALLHALFAALAFMKLLGNVSMSPIFIVMIIYTIVYFIFAMISFIHSSRMIKHSI

SEQ ID NO: 4616 - protein, 70 aa, Staphylococcus epidermidis
EVRVLSFYRFMKNFEGEKSHFGDLFEGMKDINFPENITTPREIMEKFQHWLQEPSLHDTIQDAIKQYQNK

SEQ ID NO: 4617 - protein, 271 aa, Staphylococcus epidermidis
YKFSDNLGEGYNMTLTNKEVAKVLFKAYRYKKPIDFISENYQLNEEEAYHVQEELIDQLTFKDRSTVTGYKVSMTSKATQAIANTNEPAYGTLLSNQIVNDGASVSLSELFSPLLEPEIIFIVQEDLPYDADLETIRYHTRIAPGIEIPDARYKNWFPNFTLSDLISDNTATGLVVVGDPVDGLDNDAFANVHLNLYKDDKCIATGESSEVLGNPLNAIHWLIKKLHTHGKQLKKGDIISSGTFISPLKLEYGTYRAEYSGIGKVSFSVNK

SEQ ID NO: 4618 - protein, 616 aa, Staphylococcus epidermidis
RRLSMSHLLNQLKSNVLVADGAIGTIFYSEGLDTCPEAYNLTHPDKVERIHRSYIEAGADVIQTNTYGANFEKLKSFGLEHKVKEIHQAAVQIAKRAANEDTIILGTVGGFRGVRQEDISLSTIQYHTELQIDTLIDEGVDALLFETYYDLDELTRIVTATRQKYDIPIIAQLTASNTNYLVDGTEINAALKYVVECGANVVGLNCHHGPHHMQRSFSHIELPKHAYLSCYPNASLLDIENSEFKYSDNAQYFGDIAQELINEGVRLIGGCCGTTPEHIRYIKSAVKHLKPVKDKKVIPINKASSQKQTRVLKQNLTSKVKNGPTVIVELDTPKHLDTDTFFDNVGKLDEAGIDAVTLADNSLATVRVSNIAAASLIKQRYDIEPLVHVTCRDRNLIGLQSHLLGLSLIGVNEILAITGDPSKVGHLPGATNVYDVNSKGLTELALRFNKGINTDGDALKKHTNFNIAGAFDPNVRKLDGAIKRLEKKVASGMSYFITQPVYSKEKIIQVYEETKHLNTPFFIGIMPIASYNNALFLHNEVPGIKMSDDVLNQFKAVKDDKEKTKELSLRLSKELIDTVHEYFNGLYIITPFQKVDYSLELAAYSKSITANKEAIL

SEQ ID NO: 4619 - protein, 78 aa, Staphylococcus epidermidis
GKSSCTIKIISGSSNGENNSERETEAPSLTIWLDKSVPYAGSLVLAIACVALLVILTLYPVTVERSLKVNWSISSSCT

SEQ ID NO: 4620 - protein, 217 aa, Staphylococcus epidermidis
RRYPREMNKLIDFSKGLVPVILQHAQTDSVLMLGYMNEEAYQKTLKEKKVTFFSRSKQRLWTKGETSGHFQHVESIHLDCDQDAILIKVMPQGPTCHTGSLSCFNSEIESRFKIQALAQTIHQSAKANQSNSYTQYLLKEGIEKISKKFGEEAFEVVIGAIKHNREEVINETADVMYHLFVLLHSLDIPFSEVEQVLAHRHQKRNNFKGERKEVREW

SEQ ID NO: 4621 - protein, 206 aa, Staphylococcus epidermidis
NAMLRVALAKGRLLKSFIEYLQQVNQIDIATVLLNRQRQLLLTVDNIEMILVKGSDVPTYVEQGIADVGIVGSDILNGQKYNINKLLDLPFGKCHFALAAKPETSRYKKVATSYVHTATQFFNKEGMDVEVIHLNGSVELSCVVDMVDAIVDIVQTGSTLTANGLVEKKHISEINAKLITNKESYFKQSSEIERLIKQLGVSINYA

SEQ ID NO: 4622 - protein, 435 aa, Staphylococcus epidermidis
KRLTHRRCITMSENIIMPKLGMTMKEGTVEEWFKSEGDTVKQGESIVTISSEKLTNDVEAPASGTLLEIKVQAGEDAEVKAVLGIIGEEGEAIDKDEDDLASEKVKEDNEHEKETQEVKDTSQPSSDNKDNSPKSAARERIFISPLARNMAEDKGLDINKIKGTGGNHRITKLDIQRVEANGYDYASDTTSNEDTSHVPTQTVDTSAIGEGLNPMRQRIAQNMRQSLNSTAQLTLHRKVDADRLLDFKDRLATELKQADQDVKLTVTTLLAKAVVLALKEYGAMNARYEQGELTEYEDVHLGIATSLDEGLMVPVINHADTKSIGTLAHEIKSSAEAVREGNTGAVQLEGATFTITNMGASGIEYFTPILNLGETGILGVGALTKEVVLEADNIKQVSKIPLSLTFDHQILDGAGAADFLKVLAKYIENPYLLML

SEQ ID NO: 4623 - protein, 178 aa, Staphylococcus epidermidis
MLETHRLKLVKPNLSYTDELYQLHTNKVATKYTPKGIHQNKVATQDFIKGWMRHWDEYQFGYFILIMRDNHEVVGIAGFEYRTIHQQQFLNAYYRIFPSYTGVGLAFESMEEIARHLKKHDTITPKLIRTNQYNTNSIKLAQKLGYNYDANWDDVINKGDRCFLTYKRWIITKSMMNS

SEQ ID NO: 4624 - protein, 60 aa, Staphylococcus epidermidis
NTRTHIINAWDTLNVSGIFIYGNRCINRKYNELYQIFKLSYTSEEHKVLFNLCSTSFIYT

SEQ ID NO: 4625 - protein, 330 aa, Staphylococcus epidermidis
LKLTKEEHRFMDYRVLLYYKYVTIDDPETFAAEHLKFCKEHHLKGRILVSTEGINGTLSGTKEDTDKYIEHMHADSRFADLTFKIDEAESHAFKKMHVRPRREIVALDLEEDINPREITGKYYSPKEFKAALEDENTVILDARNDYEYDLGHFRGAIRPDITRFRDLPEWVRNNKEQLDGKNIVTYCTGGIRCEKFSGWLVKEGFENVGQLHGGIATYGKDPETKGLYWDGKMYVFDERFSVDVNQIDKTVIGKEHFDGTPCERYINCANPECNKQILVSEENEEKYLGACSYDCAKHERNRYVARHHISNEEWQRRLNNFKDVPEHTHA

SEQ ID NO: 4626 - protein, 321 aa, Staphylococcus epidermidis
EELTMKMEKEQAHWIYKTMNEIRFFEEKVHKIFSDGRIPGFVHLYVGEEAVATGVMSQLNDDDYITSTHRGHGHAIAKGCDLNGMMAEIMGKRDGLGHGKGGSMHVAEIDKGMLGANGIVSGGFGLAIGASISIINQGKDNVAVCFFGDGAANECNFHEGLNFASILDLPVLFICENNQFAEGTTHDYASASETIAERAAAYNMPGVRVDGMDVMEVYKATQEAVERAKKGEGPTLIECDTYRKYGHFEGDEQKVKSPDDRNADKNATVEFRKRAIEENWLTEKEADEIEKAAEQAVEDAVKFAEESELPDEDSLYKDVFA

SEQ ID NO: 4627 - protein, 198 aa, Staphylococcus epidermidis
RNGAYVMNYQIKRNTEETQLNISLANNGTQSHINTGVGFLDHMLTLFTFHSGLTLSIEATGDTYVDDHHITEDIGIVIGQLLLELIKTQQSFTRYGCSYVPMDEALARTVVDISGRPYFSFNSKLSAQKVGTFDTELVEEFFRALIINARLTVHIDLLRGGNTHHEIEAIFKSFARALKISLAQNEDGRIPSSKGVIE

SEQ ID NO: 4628 - protein, 78 aa, Staphylococcus epidermidis
LYSHFIKIYIKCHYSYTTTLLFIYENHHILYRSNDGFIGYLIESNSHFDTILKCLIFKLQSLSFFYINSNTFKLTKID

SEQ ID NO: 4629 - protein, 513 aa, Staphylococcus epidermidis
LFLHEFLNQRKVSKKMANKESKNVVIIGAGVLSTTFGSMIKELEPDWNIKLYERLDRPGIESSNERNNAGTGHAALCELNYTVQQPDGSIDIEKAKEINEQFEISKQFWGHLVKSGNISNPRDFINPLPHISFVRGKNNVKFLKNRYEAMRNFPMFDNIEYTEDIEEMRKWMPLMMTGRTGNEIMAASKIDEGTDVNYGELTRKMAKSIEKHPNADVQYNHEVINFNRRKDGIWEVKVKNRNSGDVETVLADYVFIGAGGGAIPLLQKTGIPESKHLGGFPISGQFLICTNPDVINEHDVKVYGKEPPGTPPMTVPHLDTRYIDGERTLLFGPFANIGPKFLRNGSNLDLFKSVKPYNITTLLASAVKNLPLIKYSIDQVLMTKEGCMNHLRTFYPEARDEDWQLYTAGKRVQVIKDTKEHGKGFIQFGTEVVNSKDHSVIALLGESPGASTSVSVALEVLEKNFAEYEKDWTPKLQKMIPSYGKSLIDDVKLMRATRKQTSKDLELNYYESK

SEQ ID NO: 4630 - protein, 164 aa, Staphylococcus epidermidis
SQCKLLIFVSNLPPQVVHHFNFKLRRDLSMKLSIFHDGQFFVGVVEYQKGFIHKYLKVTFGNEPSDETVLRFITFKLIPLLNQTHGKKKPIQKHKKINPKRLQRKIAKEQKETNLTTFAQQAIKEEQELNKLKSKKLQRLEKERHRQYKRMLKRKKAHEKHKGH

SEQ ID NO: 4631 - protein, 208 aa, Staphylococcus epidermidis
KAVNLMRAKKLISHLTVSRITSTRNVIIVIKREGVIIMTKFNFDQVHSDIQFKIKHLMVSQVKGTFKQFDVQLDGDINDLTSLKATATIIPSSIDTQNEDRDNHLRSNDFFGTEDNDKMTFVTKEINENQVVGDLTIKGETHEETFDVEFNGVSKNPMNGQQVTGFIVSGTINREKYGINFNQALETGGVMLGKNVKFEASAEFSIDN

SEQ ID NO: 4632 - protein, 172 aa, Staphylococcus epidermidis
YIMKRFAKAFVVSGITLGAVLGLNVTEHNGVSNEAKAQTAHSYWYKYNGYTASGGDFVLSNSFYQGLKAGNVTFNGIKVNQKYESKTATKKIYDQTFQQINGNKANNVQFKIASRTVTLDQVKQKYGKNYNYQPSLSKNKTSKTDGLYGYQVGKGNIVFHVKDGYVTSATLS

SEQ ID NO: 4633 - protein, 538 aa, Staphylococcus epidermidis
KGMNKNIKMKNKRKINNTLVYTISVLIIVVITLIAGIFPKAFGMYAQSVYDWITNWFGWLFLIIVFILDVFLIFLAFSRYGRFKLGSDEEEPEFSMLSWIGMLFSAGLGVGIVFWGVAEPLTHYLHSPFPGKIADHSEESARVAMGYTFFHWGISQWSIFAISGLIVAYFQFRKQRNGLISTAMEPVFGEAYKRPFRNIIDILAIIATVMGIATSIGLGIMQIGGGLNHLFDVPNNNFTKILITILMVAIFLGSSLTGLNHGVKWLSNLNILLGAILLIFILIFGDLKFILESYTLAISDYLQHFIEYSLRVNPYSGDDSWIQQWTVFYWAWVISWSPFIGGFVARVSRGRTIREFVVGVLIIPPLISFTWIAGFGGTAIKLALNHNDKLVHIVDKDYTVALFELLSHFPLSEVTSSLAIVLIFIFIVTSADSTTHIVAGMATGGSINPTLKHKVLWGLLIGAISVAMTIAGGLKSLQTASVITGLPFSIILLLMIFSLMRALKREPIHHFKMTSIDDEKDYSISLEEREKQDEQDNK

SEQ ID NO: 4634 - protein, 70 aa, Staphylococcus epidermidis
FAKKEYKKSSNEVGSTSLEVSGVGVNFVSKFIYSNLILIKVLSIGRNILYLFIFSSSFLYFTGKVFYLDS

SEQ ID NO: 4635 - protein, 323 aa, Staphylococcus epidermidis
  UNSURE (42): Identity of amino acid at the above locations are unknown.
GTTEYRGSLGSLNQLMITIGILAPYLVNYAFADIEGWRWMLXLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 4636 - protein, 101 aa, Staphylococcus epidermidis
IPSEVKLKKFLKIIQKTIHYINHHLESAIEIYSTYTQTDISNQLNKDTIEATAKCFTNDLSMSSDYYNDLQLWLKEVNDIKDTINPTLYFTNQLLFSRYTK

SEQ ID NO: 4637 - protein, 478 aa, Staphylococcus epidermidis
VKEDGVVGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILAPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGVFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 4638 - protein, 263 aa, Staphylococcus epidermidis
LVMDIQKFESYLKIKHSYYSNPSLEALNYYVRRFMITVPFENINVQNKIPISIDIKDLYNKIVIQRRGGFCYELNHLFATYLEHKGFHVTRAAATVHTPNGGRSPEGSHMSLYVNIEGTLYITDVGFGDLPTSIIEIGSKTQFIPTYDKNGVYCAVWINDNQYALQKLRQNKWMTLYEAHLKPQSIKDFKDKISYNEHHPHSIFVRHLLITQPQSFGRATMTYHSLTLSNDSTKHKYDVTTNNYKYFLKKYFNLNVSIIPFEP

SEQ ID NO: 4639 - protein, 149 aa, Staphylococcus epidermidis
IYSLLINNKEICPLDLTNQKILHLLEQNSKLSLSEIGKEVNLSTPSVRERIYKLIDSKIIERYTIDINYDALGFDINVLIEVTIKNNLYKDFKAFISVQNNVDFCYRISGDSCFIFKAHFKKMSEVETLINEIQYYGHTKTHFIFSETK

SEQ ID NO: 4640 - protein, 353 aa, Staphylococcus epidermidis
PHKEVFTMSEERKLTFMGAINEAIDQSMEKDEDVILIGTDVSGGAKVDHIKDDDTFGGVFGVTKGLAKKYSRKRVIDTPIAEHITLSTAVGAAATGLRPIAELMFNDFIGFGLDPILNQGAKMRYMFGGKAKIPLVVRTVHGAGASAAAQHSQSLYNMFAAIPGVKVVVPSNPYDAKGLLMSAIQENNLVVFSEDKTLLGQKGNVPEEPYTIEIGKANVTREGDDLTIVAIGKMVAVAEETAEKLAEDQVSVEVIDLRSVSPWDQETVLDSVKKTGRLIVIDESNPQCNIAGDVASVIGDVGFDYLDGPIKKVTAPDTPVPFAANLEAAYMPNADKVLDIASELIDDLKKANA

SEQ ID NO: 4641 - protein, 120 aa, Staphylococcus epidermidis
VASLLECIVTAPAGLIYVIYLWQQQHITFGLNISSFWLLFSGAITAIPLILFSAGAKRIPLSLTGFIQYVGPTIMFILGIFVFKEPFNTDQLITFIFIWIGIVLYSISQYVQIKKNPVVK

SEQ ID NO: 4642 - protein, 176 aa, Staphylococcus epidermidis
TLRLKVKGSMKMKSSVRLLNHIIKIMNLQQSLIIRDEQWNQSYEAYNFNINGYVFKSRLAKKTTKKKGYFLSLWEKDKTKKNRAFDYESFPGKLIVHVLDDSQVGQFIFPKHVLFHKGILRNHASKGKMAFRVYPTWEKDLNRVAHKTQEWQKQYFIDMSQTIDVPSIKRAYFNED

SEQ ID NO: 4643 - protein, 213 aa, Staphylococcus epidermidis
LNGWRNFFMDKLTVGLEWFLNPDHMPLILGIEKGWFKEESLEIEMIEPKEHFDALDEIENGSMDIAITEPIHLVQDRAKEQKVIGFARYLHTNGGIMYNKDKNIARPKDLIGKRLQYPGAPGPGGIAMAKTMIEADGGTFEEGDITPVNHSFYHTDALLTDKADAATLIFENFEILEARNQGLNVDYFPLKNYNVPDFCQLIFITTPEVLNTE

SEQ ID NO: 4644 - protein, 219 aa, Staphylococcus epidermidis
VYLRSVCMEILVTAFEPFGDEKINSALEAVSHLETKIGCHKIDRLILPTVFHDSADMIAKVLKSKNYDVALAIGQAGGRSEITPERVGINIDDARIKDNQGHQPIDQVIRHDGAPAYFSNLPIKRMTMAIQKAGLPSRLSNSAGTFVCNHILYQLGYMADHFYPDLLFGFIHVPLIPEQTINHSQQSSMSVEDIVKGLTEAIKAIDFVEDNKIALGEIQ

SEQ ID NO: 4645 - protein, 276 aa, Staphylococcus epidermidis
GRGGLSMNNTIISMKEKELRFLKFFHQQKYNVVDFNLIEELDWQRLTHEDLQQMDERSFWQQNKSIYALRNDFTDQLFRYYSNYPTHFKKVAYAGDIIRDNRVIKQVGIENYEPQFDNITQNFLDFQYFIQNVLHDDIQFIILGHYQLIDALLEKNHQTREVMEMIEERNLSGLIQTLTFNHPIIQILKENTLNQLKILSHYLPERHPAMVAIQSWSQWFTDHGITEIHLDVTAQAPRSYYKGIFIKCHLKNTAHSVLTGGYYHGSLEGFGLGLTL

SEQ ID NO: 4646 - protein, 332 aa, Staphylococcus epidermidis
IKRGIQSMANQKLPTLKYTGKSESAVPIVSESELQTVTAEPWVKISDKGLQLEGLNFNREGQLFLLDVFEGNIFKVNPATKEVTTKFQSVKDNPAAIKVHKDGRLFICYLGDFKTTGGIFATTEKGEQIEEIISDLNTEYCIDDMVFDSKGGFYFTDFRGYSTQPLGGVYYVDPDFKTVTPIIQNISVANGIALSTDEKVLWVTETTTNRLHRIALEDDGVTIAPFGATIPYYFTGHEGPDSCCIDSNDNLYVAMYGQGRVLVFNKRGYPIGQILMPGRDDGKMLRTTHPQFIPGTNQLIICTNDIENHSEGGSMLYTVNGFAKGYESYQFQ

SEQ ID NO: 4647 - protein, 258 aa, Staphylococcus epidermidis
ILGGIILIKKRVIPCLDVKDGRVVKGIQFQSLRDIGNPVDLALYYNEAGADELVFLDISKTEAGHDLMIEVIEATAKQLFIPLTVGGGIQNLDDITQLLNHGADKISLNSSALKHPELIRQASEKFGRQCICIAIDSFYDKDREDYFCTTHGGKKLTDVSVYDWVQEVEHLGAGELLITSMHHDGMKQGFDIEHLAKIKQLVNIPIIASGGGGNAQHFVELFQQTDVSAGLAASILHDQETTVAEIKDKMREGGILVR

SEQ ID NO: 4648 - protein, 256 aa, Staphylococcus epidermidis
LSMGWNESHFLIIYIEGGLMVSSEYKKGIFLALGAYILWGILPIYWRLIDEIGAFEILAFRIIFSVIFMIFVLIIGKNQRNAFLRDVNQLVSHPVQLIAIIVAGYVITVNWGTFIWAVSNGHVLQSSLGYYINPLVSIVLALIFLKERFNKFEWLAIIFALIGVLYMTIKIGEFPFISLLLAFSFGIYGLLKKIVHIDAISSITIRMYCYCTSRFNLCYLPMAATTHNIWIKYIIILATIFRCNYSNTIDSVLSRC

SEQ ID NO: 4649 - protein, 196 aa, Staphylococcus epidermidis
KYDINEMGDKMYKYLKRNRFSTQTSIIKNDAQQPVGMISKVYKNFIQKCIGYLTLGLKLNQYEICDVNNNSVAYIKVSRYMEKKHFKVEYHDSKGRQCEALFDKQSNGYEETYGILKIDGIILNIHANEKHHTTIKDIKRDTQIASWKQIGDYAYAEGNDGLFKEHQLLYILIMHAFANTYVSKRQTSLMFPGPPV

SEQ ID NO: 4650 - protein, 138 aa, Staphylococcus epidermidis
MAIINLSHRGDTSFDKLLGHLPSVQEKWNALEDILKNEGQLSVDLKEEIRKILAQNSGCLYCKSKGKPNKKFTDEKSLVCIGFVDVYVSQNGRVPQSTIQVLTKTLTDIEIVELLAFISFTHCQQEFGAMMNLQPSNN

SEQ ID NO: 4651 - protein, 77 aa, Staphylococcus epidermidis
KLIIKNVERFHYKRKNFPKNTCQITCNMLVYYYIFTLMYYRTKEFGVREGWLKYEQYHHFNERKGITFFKVFSSTKI

SEQ ID NO: 4652 - protein, 192 aa, Staphylococcus epidermidis
MIAIIDYGLGNISNVTRAIQHLGYDVILTCDDKDVQKAEAIVLPGVGHFQDAMHSIEEKSIKDMLKNIHDKPIIGICLGMQLLFQHSAEGDVSGLELVPGNIVPIQSSHPIPHLGWNELKSTHPLLQSDVYFVHSYQAEMSEYVVAYADYGTKIPGVIQYRNYIGIQFHPEKSGTYGLEILNQALKGGFIND

SEQ ID NO: 4653 - protein, 167 aa, Staphylococcus epidermidis
LPPVPFILLMSNPLSSAILRARGEIKILSRAALLGELSLLSEDGCDVSLTSCVSFSCSLSSFTFSDAKSSSSLSIASPSSPIIPNTALTSASSPACTLISNNVPLAGASTSLVNFSELIVTILSPCFTVSPSDLNHSSTVPSFIVIPSFGIIIFSLIVIHLLCVSLF

SEQ ID NO: 4654 - protein, 243 aa, Staphylococcus epidermidis
IKRLKEGLLMIDLWPAIDLINSTSVRLTEGKYDSKEKMEKSVEDSIRFYSQFKCVKRIHIVDLIGAKAKEVKEFDYIRSLRKLTTKPIEVGGGIRSKQTIENYIHSGIDYCIVGTKGIQDIEWLTHMTHQFPNKLYLSVDAFGEKIKINGWKEDAKLNLFDYVAKIEHLPLGGVIYTDISKDGKLSGPNFDLTGRLALYTSLPVIASGGIRHQEDLFRLESLNVHAAIVGKAAHLDEFWEGLS

SEQ ID NO: 4655 - protein, 68 aa, Staphylococcus epidermidis
FKPVNEDPKNMATIKIVIKILVKLLLGTSKRWFNPPPICIIPKPIDVAIPMTVAIIANISIIFLKGRL

SEQ ID NO: 4656 - protein, 573 aa, Staphylococcus epidermidis
TLEVENMKSAQALKQNLTSLDGQKYGAYKQIKDLYEFNLFKLRINHIQADPFAPPSKMSVVIDRQQAKFPDSLLNSELKQRAVSDYLTRVFHKQIQSIVAQDKKVSKIQIDSCGQEILERTAIVIKNHQIEARIEVGLPARGRTILGRIARHTLINVLPQIVEHALCYRNINGSQLQQQVELMMDQEEIRQQLVKRDLVAFVANGAILPRKSGVSDLPMNNAIEFKSPKQYEIVMKLSSGKVIKGMGIPKGITLIVGGGYHGKSTLLEALERGVYNHIAGDGREYVITNQDAMKIRAEDGRSIQNVNIQPFIDHLPGEKDTTHFSTENASGSTSQAANVMEALESQASLLLIDEDTSATNFMIRDGRMQRLIAPEKEPITPFSNKVKALYDDHNVSTILIVGGSGDYFDVADQVLMMDEYVLKDVTQHAKDIAQSDGYQRRLSSHYQFGHIPSRIPLRASFNQKGKRDRFKAKGLNVVTYGKETIHISGLEQLVDDSQTQGLAMMLSYVKNELLDDKSTIVELTNSLYQRIEKHGLDVISNHQGHPGHLALPRKQEFIATLNRYRRLKIKQRE

SEQ ID NO: 4657 - protein, 474 aa, Staphylococcus epidermidis
NFLFLMQMKLGWHNVLLVKGGIYYMSKSYDLIVIGAGPGGYVAAIRGAQLGKNVAVIEKNNAGGTCLNVGCIPSKTLLEHGEKAHSIRVANDWGITTKDLKIDFTQFVQRKKKVVQTLTGGVKQLLKKNKVTYIEGEARISKNLKVDVNNETYQAKDIILATGSQPFIPPIDGLDQVNYETTDTFFDLEKLPKQLAVIGGGVIATELASSMADLGVRVTIIEVADDILLTEINETREMLKAHLDNQGIKILTKAKIKQVKESKIILDGQDDVSFDTLLVATGRQPNTQVAKDLNLEMDGKFFKVNEHYETSQKHVYAIGDLIKGYQLAHAASAHGIHVVETIMNKQPSLVRQEDITRCIYTRLEAASVGLSEEQAKEAGYDVKVTQSAFQGNAKALIKGENEGFIKLVVDKKYGEVLGAFIVGPHATDIIGELLSVKASEGTIHELSQIIQPHPALLEAIGESADAFFDSAIHM

SEQ ID NO: 4658 - protein, 419 aa, Staphylococcus epidermidis
ECLLTMLSAQQFLKEFNNVESLDESLYEIVSQICEEVKLQGDKALKNYNLQFDQVETEKLELEQSQLKNAYDMLDNETRDALEQSYQRIKVYQENIKVKQESSQQTECYERYHPIERVGIYVPGGKASYPSTVLMTATLAQVAGVNEITVVTPPQNSGICQEVLAACYITGVHHVYQVGGAQSIAALTYGTETIKKVDKIVGPGNQYVAYAKKFVFGQVGIDQIAGPTEIALIIDESADLDAIAYDVFAQAEHDEMACTYVISENEKVLNQLNTIIQEKLQYVERQDIISQSIANHHYLILAQDTEEACLIMNTIAPEHASIQTRAPEMYIDKVKYVGALFLGHFSPEVIGDYVAGPSHVLPTNQTARFTNGLSVNDFMTRHSVIHLSQKTFNEVAESAEYIAHIESLFNHEKSIHVRR

SEQ ID NO: 4659 - protein, 83 aa, Staphylococcus epidermidis
LISSLGKKMGSNVKDSKITPNKISLFTGSLVTNEITTIVQYKNMESIFFRFTRRLGIGCFLVAAGAYKIVIINPTNAIDKRTK

SEQ ID NO: 4660 - protein, 71 aa, Staphylococcus epidermidis
MSLSNEEMICNIRQKLNIVNQALLNPEKFKSTPHQDISEIYEFVMSKDSFSPSEVTAIADHLGQLRQDMED

SEQ ID NO: 4661 - protein, 498 aa, Staphylococcus epidermidis
IFKSIGDVKVYQYNDDSLMLHNDLYQINMAESYWNDGIHERIAVFDLYFRKMPFNSGYAVFNGLKRVVNFIENFGFTNEDITYLKSIGYEEDFLNYLKDLKFTGNIKSMQEGEICFGNEPLLRVEAPLIQAQLIETILLNIINFQTLIATKASRIRQIATHDTLMEFGTRRAQEIDAALWGARAAFIGGFDSTSNVRAGKLFNIPVFGTHAHALVQTYGDEYIAFKKYAERHKNCVFLVDTFHTLKSGVPTAIKVAKELGDTINFIGIRLDSGDIAYLSKEARRMLDEAGFTEAKIIASNDLDEQTITSLKAQGAKVDGWGVGTKLITGYDQPALGAVYKLVSIETDDGTMSDRIKLSNNAEKVTTPGKKNVYRIINNKTGKAEGDYITLEGENPNDESPLKMFHPVHTYKMKFIKSFKAVNLHQSIFENGKLVYHLPDEYEAQDYLKNNLSILWEENKRYLNPQDYPVDLSTKCWENKHKRIFEVAEHVKEMEDENE

SEQ ID NO: 4662 - protein, 252 aa, Staphylococcus epidermidis
RSIPLYISYECCSIERWRNMTRKYISTEMLIIFTALMIIANFYYIFFEKIGFLLVLLLGCVLVYVGYVYFHKVRGLLSFWIGTLLIAFTLLSNKYTIIILFIFLIVVIIRYLVYKFKPLKVIATDEDITSPIFIKQKWFGEQHTPVYVYKWEDVQIQHGIGDIHIDMTKAANIKETNTIVVRHILGKVQVVVPLNYNINLHATLFYGTAYVNDKSYKIENNHVQIEEKTKDDNYTVNVYVSSFIGDVEVIYR

SEQ ID NO: 4663 - protein, 458 aa, Staphylococcus epidermidis
KRTFLIKNVIMYSFCRSYNTYDRSLQRMIERYSRDEMSSIWTDQNRYEAWLEVEILACEAWSELGYIPKEDVKKIRENAKVNVERAKEIEQETRHDVVAFTRQVSETLGDERKWVHYGLTSTDVVDTALSYVIKQANEILEKDLERFIDVLAAKAKKYQYTLMMGRTHGVHAEPTTFGVKMALWYTEMKRNLKRFKEVRKEIEVGKMSGAVGTFANIPPEIEAYVCEHLGIDTAAVSTQTLQRDRHAYYIATLALIATSMEKFAVEIRNLQKTETREVEEAFAKGQKGSSAMPHKRNPIGSENITGISRVIRGYITTAYENIPLWHERDISHSSAERIMLPDVTIALDYALNRFTNIVDRLTVYEDNMRNNIDKTYGLIFSQRVLLALINKGMVREEAYDKVQPKAMESWETKTPFRELIEQDSSITDVLSSEELDDCFDPKHHLNQVDTIFARAGLS

SEQ ID NO: 4664 - protein, 168 aa, Staphylococcus epidermidis
LKMLSKELLAALNEQMNQEYFAAHAYMAMAAYCDKESYDGFANFYIEQAKEERFHGKKIYDYINDRGEHAIFDTIKAPKVEFSSILETFKDSLAQERDVTQRFYNLSELARNDKDYATISFLNWFLDEQVEEESTFETHIDYLTRIGDDCNTLYLYEKELAARSFNEQ

SEQ ID NO: 4665 - protein, 100 aa, Staphylococcus epidermidis; identical to SEQ ID NO: 3071

SEQ ID NO: 4666 - protein, 70 aa, Staphylococcus epidermidis
TLTFPKCISKGATYKYRRHCFFISTHPTFHIFFSVLEGNAHHFVHDLLLINHRHKLFTIQSLTANTLKCP

SEQ ID NO: 4667 - protein, 279 aa, Staphylococcus epidermidis
PLFTIKYIIYIYRWREKFFFLNLAQKTRFVKLRYPLLTRFYSHGLAQILPGLVLGSHLLGDMYKMQTAQTMSIMQVSIFIIAALLIIFMQATIKNPTQLEQGHKEPKRYIFAWVLLGFCIVMIYQIIISIILFAINGSPQRSPNTERLMAIAKQMPIFIVLISIVGPILEEYVFRKVIFGELYNFIKGSRVVSFIIASIVSSLIFALAHNDFKFIPVYFGMGVIFSLAYVYTKRIAVPIGIHMLMNGSVVLTQVVGGDSIKKLQELKAPNIYIPSYILK

SEQ ID NO: 4668 - protein, 279 aa, Staphylococcus epidermidis
KGEFEKRRKPMKRSDKYTDDYIEQRYESQRPHYNTYYQPIGKPPKKKKSKRIFLKAIITILILLIIFFGVMYFISSRANVDDLKSIENKSDFVATENMPNYVKGAFISMEDERFYKHHGFDIKGTTRALFSTISDRDVQGGSTITQQVVKNYYYDNERSFTRKIKELFVARKVEKQYSKNQILSFYMNNIYYGDNQYTVEGAANHYFGVTVDKNNSNMSQISVLQSAILASKVNAPSVYDVNDMSNNYINRVKTNLEKMKQQNFISESQYQEAMSQLGN

SEQ ID NO: 4669 - protein, 384 aa, Staphylococcus epidermidis
IVYTYTIKIRNEIIMKIVEVKSKNGTNFMILDGNNEPIVDAVRYLKYLDSVKKSLNTKKTYAYALKNFFVYLESKKICYKEVSFDNFVDFIRWMKTPFEYENVLSYHRKEKSISPKTINLTMTVVSNFYDYLYRSKKLDVNFYDFMHMESKYSKKYKSFMHHINKDYRTLKNILKVKEPKKKIEVLTNAEVKKLLEEANNIRDKFLIQLLYETGLRIGEVLSLRIDDIKFDFRKGHQIVLKNRFNDNGTYLKTGERKIFISQSLIDLYDDYVYEIIDELSICSDYLFVKIKGRNVGEAMNYSDIYSLFKRLKHKTSINVHPHLFRHTHATVFYNETKDIKQVQERLGHSNIQTTINLYVHPTEEDIREDWNKVKHQFQVFNKGE

SEQ ID NO: 4670 - protein, 362 aa, Staphylococcus epidermidis
EAHTTMKDNKPNNSKLIQTYLSKKTLRYGTASALTLALYLFNSNVTVYADENTANQNQGTSPKISQTAPTNNTENTDATAITTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNGKEQNQANTSVTNTQITKNEKDEDTKTLKKDKDEKESKDTKTPKKDKEKKDIKTPKKDREEKKPVIPSNGKVEKDEDTKTPKKDKEKKITKTLKKDREEKSPVIPKSGKDEKDTKITKKDKEDEITTTSKKDNNNDVQDKLPETGKTKDIQNPALIMLLTGLGLLGLFRNKIRE

SEQ ID NO: 4671 - protein, 236 aa, Staphylococcus epidermidis
IKEFHKMYDITKWKHMFKLDPAKSISDENLEALCMSNTDAIIIGGTDDVTEDNVIHLMSRVRRYPLPLVLEVSNVESVMPGFDFYFIPTVMNSKDTKYHNEILLEALKKYGHVINFDEVFFEGYVVLNANSKVAKITKAYTQLGIEDVEAYAQMAEELYRFPIMYVEYSGTYGDVDKVKAIANMLQHTQLFYGGGITNIDKANEMSNIADTIVVGDIIYNDIKKALKTVKIKESNK

SEQ ID NO: 4672 - protein, 192 aa, Staphylococcus epidermidis
SKWLNTIKVVWSMVKESIPKEGENIKIQSYKHDGNIHRVWSETTILKGTEHVIIGGNDHTLVTESDGRTWITREPAIVYFHSEYWFNVICMFREDGIYYYCNLSSPFACDEEALKYIDYDLDIKVYPNGKYHLLDEDEYEQHMNQMNYPHDIDIILRRNVDILQQWIEQKKGPFAPDFIKVWKERYKKIRDY

SEQ ID NO: 4673 - protein, 100 aa, Staphylococcus epidermidis
PFATLPEQFETIYQYMIDQNKVSRPVLSDDQLSQLNIHLHEALQQSRPVNIKYYEEGYINFIELIVHRIDSINYEIEGTAPHSRERHKVSFLDIIDISFI

SEQ ID NO: 4674 - protein, 402 aa, Staphylococcus epidermidis
MKRTIFLLMSILLLLTACGDGHKQTSSDKEQSEHKDNHNKNQVKQIATDKKVQGDNYRTILPFKESQARGLLQDNMANGYNGEDFESGLLELSKEIFPTNKYLYQDGQYLDKKTINAYLDPKYTKKEIDKMSEKEKKSKNANENLGLNPSHNGETDEEKIAENSPAYLSNILEQDFYGNSDSKGKNIKGMTIGLAMNSVYYYKKEKDGETFSKDLSDKEIEKQGKQMASEMLSRLRENSDLKDIPIHFAIYKQSSQDSITPGEFIVGTTVEEGKTKINSWDNINEKAALIPSSTAADYDETLNNNFKQFNDNLQSYFSNFTQAVGKVKFVNKKAKQLTVDLPIDYYGQAETIGITQYVTEQAEKYFDKLDEYEIRIKDGNTPRALISKTKDDKEPQVHIYHN

SEQ ID NO: 4675 - protein, 691 aa, Staphylococcus epidermidis
RGMTMSIPINLPTNSTMINELCTLQSRTINIKGEVLITEIYDDYFFKNDEWHITAFNKFKQFQDSIKNYRDKRKNVFFRIKSKNLNLEFKYLFLKLIVKEDWSLSNLFNTGAVKLNKIAKFFNEVYPNLNSLLDCDINTLEKHWFNWLTENNIPIKRRSSTIVFGDYEYKSGLASFLKNMYINLIKFIDKREEWEKDKWDIRNLEKYGLSYNKTLTGNYLNFEKIESIKMRELAKKYLKNRLITGDIAFATARFYIRVLTRFFQNISKNKETRNSLNELDRCHIEAYIEFLFEYAANKHLQSTKNFVREELKTIRRFLNDIITQNYAIAPYQDIRFLIYPQDLPKHEKKNSSQIDYIPDFVLEQLFEHINDLHKDLIPVVWIAFKTGLRISDVLTLQNNCLAKVNGKYSIITDIAKTFVKGHRIPIDNKLADIIAVLIADSKSKSTKDNNPNNYIFAIYKGKRKGMPFTQHMVRAHLNHLSKTKNIIDEQGEIFHFKTHQFRHTYAVKLLNGGADILTIQELLAHSSPEMTLRYAKLLDDTKRKAFESVIDQGAFSFDVDGKIKNIQHSSELSEKALNSLWQEHKLNAMDNPYGTCHARLSGDCPYMEAPPCLTCNSGKPCKDLAIGFSDLDVEKYELHIKSTVKSIELAKNNNRQDMVEKHINILNKYEEILGNIKDGNIIFGRSNRIKV

SEQ ID NO: 4676 - protein, 82 aa, Staphylococcus epidermidis
SPKTYVKTTANNAPITVAGNLLYPFFNDALAVGSIVTIAVSMAKIGVRFNNIQNKDVKKVAKPVLIVRAPIICLYHLSFISY

SEQ ID NO: 4677 - protein, 491 aa, Staphylococcus epidermidis
MGRTLKMSIRFESIEKLTELIKNKEIKPSDVVKDIYAAIEETDPTIKSFLALDKENAIKKAEELDELQAKDQMDGKLFGIPMGIKDNIITKDVETTCASKMLEGFVPIYESTVMNKLHDENAVLIGKLNMDEFAMGGSTETSYFKKTLNPFDHTAVPGGSSGGSAAAVAAGLVPFSLGSDTGGSIRQPASYCGVVGMKPTYGRVSRFGLVAFASSLDQIGPITRNVKDNALVLEAISGVDANDSTSAPVDDVDFTSDIGKDIKGLKIALPKEYLGEGVSEEVKTSVKEAVETLKSLGAEVDEVSLPNTKYGIPSYYVIASSEASANLARFDGIRYGYHSKEAQSLEELYKMSRSEGFGEEVKRRIFLGTFALSSGYYDAYYKKSQKVRTLIKNDFDKVFESYDVVVGPTAPTTAFNIGEEIDDPLTMYANDLLTTPVNLAGLPGISVPCGQSNGRPIGLQLIGKPFDEKTLYRVAYQFETQYNLHDAYENL

SEQ ID NO: 4678 - protein, 306 aa, Staphylococcus epidermidis
TIDANITIVILLIYRNYNCNIGGYILKKLILLIAIALVLSACNSTSSHAKELNNLEKKYNANIGVYALDTKSGKEVKFNADKRFAYASTSKAINSAILLEQVPYNKLNKKVHINKDDIVAYSPILEKYVGKDITLKELIEASMKYSDNTANNKIINEIGGIKKIKKRLKKLGDKVTNPVRYEIELNYYSPKSKKDTSTPAAFGKTLNKLIANGKLSKKNKNFLLDLMLNNKNGDTLIKDGVPKDYKVADKSGQAITYASRNDVAFVYPKNQSEPIILVIFTNKDNKSDKPNDKLISETAKNVINKF

SEQ ID NO: 4679 - protein, 148 aa, Staphylococcus epidermidis
GGRALASIREDVQFSNPTISESSFKINENFDSENFEGFGDIKLNLKKYYYEENNEIDNNNNNNGSALLSLEIIIGDIDWKYPFMFKVEIESFFEWENFKGTDIDKFLEINGAAILYSYSRAHISHITNTSKYPSFDLPFYNFTDNDYQ

SEQ ID NO: 4680 - protein, 370 aa, Staphylococcus epidermidis
LKGAFNLRLGARIFKTGIAIILAMSIASLLPDNIGLKTLAGVSAVVAMQPSVYRSIKTVSEQAIGNVIGALLAVTMVTIFSNNFIIMGVTVILLIAILFQFNLAHVATLASVTALIIMGQHTGSFYVAAFFRFVLVMIGVLSSSVVNLIFLPPKFETKIYYNSMNISSDIFVWFKLVLNDTSEFHNIKQDGDQLNSRINKLEKIFDYYNEERPLTKKHIYQQNRKKILFREVVRTTRQAYEVLKRMSRYQNDLYQLNNQLLLQIKLELDSLVTLHEQIFKSLSKKARYDVTQLDYEVDNPQKKNLMDAFQQELIKNPHQTQYSYSNMMQIIAEIEEYRYQLEHLDRIRLSFFTYHRSDTDIDISDEDFDL

SEQ ID NO: 4681 - protein, 105 aa, Staphylococcus epidermidis
GGFYLMTKVTREEVEHIANLARLQISPEETEEMANTLESILDFAKQNDSADTEGIEPTYHVLDLQNVLRDDKAIEGIPQELALKNAKETEDGQFKVPSIMNGEDA

SEQ ID NO: 4682 - protein, 215 aa, Staphylococcus epidermidis
ACFLKNVAQNCIMTPEESSKQVKIIDKKIEQFAQYLQRKNNLDHIQFLKIRLGMQVLAINIEKSIVVYGLAIIFHTFFYTLLTHLSYFLIRRHAHGTHANSSLLCHIQNIIFFIIFPYLIIKLDINYFVLLSMALVGLIITILYAPAATKKQPIPRRLVKRKKILSIFLYCTIVVISLVTKEPVNKLILFGVILESLTLLPIFFPKEDINHGKHF

SEQ ID NO: 4683 - protein, 99 aa, Staphylococcus epidermidis
VVLLEEGLQKLIDRHHITATINRIYGSLTLYFTNEKVTHYEQVENSDGDAFAQFFKLMLNQGINLAPSKFEAWFLTTEHTEEDIDRTLEAADYAFSKMK

SEQ ID NO: 4684 - protein, 360 aa, Staphylococcus epidermidis
QYILMKLIERKGFMYLENSFKKDIEDWFHKNQRDMPWRETTNPYYIWLSEVMLQQTQVNTVIDYYYRFIHRFPTIQSLSEANEDEVLKYWEGLGYYSRARNFHTAVKEVNNNYDGEVPYDPESFKKLKGVGPYTQAAVMSIAFNHPLATVDGNVFRVWSRLNNDYRDIKLQSTRKAFEQELHPYVLKDAGTFNQAMMELGALVCTPKSPLCLFCPIQEHCEAFHMGTTQELPVKTKSLNKKTIEQKVFLIRNDNGQYLLEKRKEKLLNGMWQFPMREQTNANDVISDDLGKSIETINEPVFKLKHQFTHLTWEIKVYNVTAPLNIKENDLPKQMTWFNLDDREQYTFPVPMDKIYKFIEG

SEQ ID NO: 4685 - protein, 96 aa, Staphylococcus epidermidis
RYIYRYFRLSILSVACVMFFFRLMIDIIRVIFIRDIYIFAIFIVFISRIFVIVIFIVIIMFNSGFFRRVTSYDFSLVNNCIDFSTDNNNKACDIQP

SEQ ID NO: 4686 - protein, 111 aa, Staphylococcus epidermidis
HSIYQSAKSHVNEGGTIMLKPLGNRVIIEKKEQEQTTKSGIVLTDSAKEKSNEGVIIAVGQGRLLDNGTQVAPQVSEGDTIVFQQYAGTEVKRGDKTYLILNEEDILAIIE

SEQ ID NO: 4687 - protein, 82 aa, Staphylococcus epidermidis
EISLSCHKGIFSYAVVIYPRITRDIPVIFSEPIGFLLCGIADDPFCPFANASSTSLVSVFCKLRISTANFSIDVAISANVAM

SEQ ID NO: 4688 - protein, 112 aa, Staphylococcus epidermidis
FILYIIVIIFLGSCCNFVFFVFLSYFCVFLVFAAFWYYWAFLLSIFLQSFCDFLFFVFFWCFCVFVFLDFTVTWYYWFFLFSIFLRSFYVFLFFVFLWCFCVFRFFLIFIFL

SEQ ID NO: 4689 - protein, 318 aa, Staphylococcus epidermidis
QYMYKEILKMTKTFIFGHKNPDTDAISSALIMADFEQQTGNTEAKAYRLGEISAETQFALDYFNVEAPELLNEDLKGQDVILVDHNEFQQSADTISNATIKHVIDHHRISNFETAGPLYYRAEPVGCSATILYKMYKERGFEIKPEIAGLMISAIISDSLLFKSPTCTKEDVDAAQALKDIANVDLEAYGLEMLKAGASTTDKSAETLVNMDAKSFNMGDYVTRIAQVNTVDIDEVLDRKEEFEKVMLEMSANEKYDLFVLVVTDIINSDSKILVVGAEKDKVGEAFKVQLDDGMAFLSGVVSRKKQVVPQITEVLTQ

SEQ ID NO: 4690 - protein, 163 aa, Staphylococcus epidermidis
YIQYIPDEIEISTNFSKSLYKSVYIVYIMYIQKKRGTSMKIILKNNSESPIYEQIKQQIKENVLKGYVSPGEHLPSMRELAKDLKVSLITTKRAYEDLEKDGFVTTIRGKGTFVKEQDNSILKEKQFFVIENLAHSMSKEAKTIGMPLEELIEILTMIYEEDD

SEQ ID NO: 4691 - protein, 63 aa, Staphylococcus epidermidis
VVAQMSKKFRVEDKETIADCLDRMKKEGFMPIRRIEKPVYKENKDGSIEILKQDIIFVGALIQ

SEQ ID NO: 4692 - protein, 378 aa, Staphylococcus epidermidis
AHNHYLKYMRSYNMFINAKDFGLKGKSKYKDTRAIQKALNYAKKGRHTVYIPKGTYYIRKALVIYDSTTLLLEEGATLLRKGKDALLKNGRRLKLYHGYNGNSHIYIKGGTFDMNGGEYPYNNTAMCMGHAEDIQILGVTFKNIVGGHALDACGINGLHISECEFKGFLDIDGDRSFSEAVQLDIQVPGAFPKFGTTDGTITKNVVIEKCYFGCSDHPKMKAWNRAIGSHASRYNCYYENIHINQNIFDNLNEYALTPLKSKDTFITKNKFINCNGGIRFLGVKDGKNAADPITGQVMETQAGENFNVIGNTFIGKMKRDAIHIRSYHHVQHQNVFIAANQFEDASQSIHLENINGLTLNQEQTKIKIKSIDVKNISN

SEQ ID NO: 4693 - protein, 181 aa, Staphylococcus epidermidis
MKLHCAYAILIRTRVKVVTQVRIQSRWLIFAIFLTGAISLLIGLTYYKSIKSVDLSGYSVNQISLNHGFNQKGFVVNKKIKLDRYTFYNDKNHKDFTVKVKNKTHKVKGMVLVKDDKVETNFGIKMGDPIDKVINKLGENYKINKVGKNYHSMTYVDRFNKLKLNILYKDNIVKRIEFFSK

SEQ ID NO: 4694 - protein, 228 aa, Staphylococcus epidermidis
QTFKLTIIFWQGVSSNMKATRVFNVVVFLQFSTYLLFGMNIQLLFDKKESDYLFFIIPLFFTYIFDNSYTVLIDFCKPTEKLKKVESNNIRFINIIMLLAIIIYAYIYKNKKIRWFKDLVDSANENWCLSIILIIIMSLLISYIWSKYFIKSDYIEKLKEEDFDILGIENVINWLTKSNIKSKDISEGTNVEIEKIELLLKDEKNIDDFSYGEVKSILAYVKYVRESK

SEQ ID NO: 4695 - protein, 434 aa, Staphylococcus epidermidis
KEVKTMMNPLAQKLNDEIKQSSPEVLDMMSQLGKDMFYPKGILSQSAEAKRTTYNATIGMATKKEGKMYANSLNQMFNDLTPDEIFPYAPPQGVEELRDLWQKKMLKENPDLKSKSISRPIVTNALTHGLSLVADLFVDTDDTVLLPTHNWGNYKLVFSTRHGAHIDTYSIFDNSGHFTTSELVKTLKEYKKDKVIIILNYPNNPTGYTPNKEEVNTIVNAIEELANKGTKVVTVVDDAYYGLFYEEVYQQSIFTALTQVKSSNLLPVRLDGATKEFFSWGFRVGFMTFGIDHETLKNALEAKVKGLIRSNISSSPLPSQSAIKHVLKHHEQFDKEIDQNINILKERYEVTKQVVYDNKYAKYWQAYDFNSGYFMSLKLNQVDPEELREHLINNYSIGIIALNSTDIRIAFSCVEKEDIPYVFESIANAIDDIK

SEQ ID NO: 4696 - protein, 177 aa, Staphylococcus epidermidis
FMANTNRKSKKMSDAKCIKTRQVYPQDTNHHHTMFGGTLMANIDEIAAITAMKHAGNPVVTASTDSVDFLRPITTGDILSYEAMVSYAGTSSMEICVQIVIDDVYKNERHLAALSFLTFVALDSDGKPTSVPDVEPETSVEKWFHETAPQRVARRKERRKESIDTIEYLSRVRHIEK

SEQ ID NO: 4697 - protein, 208 aa, Staphylococcus epidermidis
HDYKKMKTSYRNQLEKNYDSRITGKRLNEETLLFLGTGAIAQRAAYLAKAFGMKVIGVSKSGKNVEHFDEVYTIEELDDVIEKANIIVNALPETEETIYLLKRKDFIQMDNNALFINVGRGTIVDEEVLINVLKDRLIRHAYLDVFEKEPLSKDNPLYDLDNVTITAHITGNDSNNNREATDIFKKNLEHFLNNYDVIENKVDLDYGY

SEQ ID NO: 4698 - protein, 126 aa, Staphylococcus epidermidis
MANKQVEISMAEWDVMNIIWNKKSVSANEIVVEIQKNKEVSDKTIRTLITRLYKKEIIKRYKYNNIYFYSSIIKEDDIKMKTAKTFLNKLYGGDMKSLVLNFAKNEELNNKEIEELRDILNDISKK

SEQ ID NO: 4699 - protein, 98 aa, Staphylococcus epidermidis
KSCKEVIEMNLEKIYEEISNEIKAMTDDEIKEVSDILYESKLLNVDYSNLKSFKADTKHSYKVKENEYNVIEKNINEKPNLENHEVNQVKNNNIIIAA

SEQ ID NO: 4700 - protein, 100 aa, Staphylococcus epidermidis
KRGNSTMENKLVPGILIGAVIGGAAALADKSTRHSLKQSFKDIKEGNRTRKPSKISSIKDEVMYWKDTLDEIRRNNPELERSIKDAKETFVNRKNQRLGK

SEQ ID NO: 4701 - protein, 464 aa, Staphylococcus epidermidis
FGGNFMTIIRDKFNNSKAFFNTHKTKNLKFRKQQLKLLSKNIKNHENELLDALYKDLGKSKVEAYATEIGMLLKSIKLMRKELKNWSKTKQTDTPLYLFPTKSYIKKEPYGTVLIIGPFNYPVQLVFEPLIGAIAAGNTAIVKPSELTPHVAIVIKDIIEDTFDEAYVSVVEGGIEETQTLLSLPFDYMFFTGSEKVGKIVYEAAARKLIPVTLELGGKSPVIVDDTANIKVASERISFGKFTNAGQTCVAPDYILVQRKVKNDLIKALKKTITEFYGENIEKSPDFGRIVNQKHFNRLNDLIQIHKDNVVFGGNSSKEDLYIEPTLLDNITNDNKIMKEEIFGPILPIITYDNFDEVLEIIQSKSKPLSLYLFSEDENMTHRVVEELSFGGGAINDTLMHLANPNLPFGGVGSSGIGQYHGKYSFDTFSHMKSYTFKSTRLESSLFFPPYKGKFKYIKTFFKN

SEQ ID NO: 4702 - protein, 66 aa, Staphylococcus epidermidis
TTLNSITLYNIVCGLFSTMLQFNCIHVLYYTTPSLVPADLGFFGHLFAFPFYFQPNTKDNEYATGN

SEQ ID NO: 4703 - protein, 195 aa, Staphylococcus epidermidis
RFLNTYWEAVLMSNKALIIVDYSFDFIDDNGKLTCGKPGQEIETFITQRIKNYHNNQQEIFFLMDLHYENDKFHPESKLFPNHNIHQTPGRELYGEVGRLYNSIKDQMNVHYLDKTRYDSFYGTPLDSLLRERQINDIEIVGVCTDICILHTAVSAYNLGYNITIPIRGVASFNQDGHQWALSHFKNSLGAKVEE

SEQ ID NO: 4704 - protein, 128 aa, Staphylococcus epidermidis
MKIKQFSFQHILFLIWKKLQIISFFLSEGEIIFNESKDKLSQKYQILNGSNEHGHEELDELLIYKESKQTGYIGLTEYYQTFNELFGSGVEIKDASIEQLMIYLEKSKHKRNTNSKYKVRFNYEAIND

SEQ ID NO: 4705 - protein, 540 aa, Staphylococcus epidermidis
TMAKDLKFSEDARQAMLRGVDKLANAVKVTIGPKGRNVVLDKDYTTPLITNDGVTIAKEIELEDPYENMGAKLVQEVANKTNEIAGDGTTTATVLAQSMIQEGLKNVTSGANPVGLRQGIDKAVQVAIEALHEISQKVENKNEIAQVGAISAADEEIGRYISEAMDKVGNDGVITIEESNGFNTELEVVEGMQFDRGYQSPYMVTDSDKMIAELERPYILVTDKKISSFQDILPLLEQVVQASRPILIVADEVEGDALTNIVLNRMRGTFTAVAVKAPGFGDRRKAMLEDLAILTGAQVITDDLGLELKDASLDMLGTANKVEVTKDHTTVVDGNGDENNIDARVGQIKAQIEETDSEFDKEKITESLGKLPGGVAVNQVWGGSETELKERKLRIEDALNSTRAAVEEGIVAGGGTALVNIYQKVSEIKAEGDVETGVNIVLKALQAPVRQIAENAGLEGSIIVERLKHAEAGVGFNAATNEWVNMLEEGIVDPTKVTRSALQHAASVAAMFLTTEAVVASIPEPENNEQPGMGGMPGMM

SEQ ID NO: 4706 - protein, 117 aa, Staphylococcus epidermidis
NNKKYSGGLILKIVSLNRLNEIENELRKQFPNEEFKFYDKAINIPINDRKTMDILIGYDGKIDRTFIEHCINLKWIGWFATGVNNLPLNYIKERDIILRNGKGIQAKQVSEYIKTFI

SEQ ID NO: 4707 - protein, 279 aa, Staphylococcus epidermidis
RMKKLFISGLIIFIIFFASGAMTWFTIDKNKYDNRHYTKTINSKIEHLSISTVTTNVNIISGKKLAVYFTGDNKINVTKNNKRLSIKEKRAVDRGYGLNFNPFHSNNRKLTIVVPEKDLKSLNIQSLLGEIDLNQVNLKHVSLETDRIIQLKRSELNQVNIESSKANFYITDCLIREGRMKLDKGITHVKNSTLSDTVFLVNRGDISMTDMKSNNDIKASTQRGNINYHFGEKPKNTLLKLHPGHGNKEIKNRYFDKGKVGNSDNILEFYTVDGDIKIE

SEQ ID NO: 4708 - protein, 108 aa, Staphylococcus epidermidis
EKEKTKVPNEYLRIFDTIQNSTDKYITKSKILNLMGYEYNSSNERWLRNAISKLIDDYSYPIGCSYKKHERGYYIITTDEEKQQAMQSIKRLADGSMKRYEALKRIKL

SEQ ID NO: 4709 - protein, 213 aa, Staphylococcus epidermidis
EKRNNMSAIAQNPWLMVLAIFIINVCYVTFLTMRTILTLKGYRYVAAVVSFMEVLVYVVGLGLVMSSLDQIQNIFAYALGFSVGIIVGMKIEEKLALGYTVVNVTSSEYELDLPNELRNLGYGVTHYEAFGRDGSRMVMQILTPRKYELKLMDTVKNLDPKAFIIAYEPRNIHGGFWVKGVRKRKLKAYEPEQLEVVVDHEEIVGGSSNEQKV

SEQ ID NO: 4710 - protein, 191 aa, Staphylococcus epidermidis
TVIEPYNKYRSENMKIFKLTSLTLAALTLAFPFSHVAQAHTYLEKHHQTNETKQSHSFSLEGEAGENPTFLTQPQFINSLDNGHLNINGYQIQQDDTNDIEYKKVYDQEIRATSNHTAISVRFSINNQSLSLESMKDAYPNERLNHIPHTSNDSQYPEDGIYVYHGKMIKLQYKVTHGFVTSVTIGEGVDE

SEQ ID NO: 4711 - protein, 143 aa, Staphylococcus epidermidis
NDDEVVNMIPNPNAPDEYKYETDYRKIPRKYLNPKIPQGRGKIKWQAFATLPQQFEILEQIIKDQNKIEKPLLTHDSLDNLDQIFQIKIQNDELCTISYWEDGNISKYTGKILKKDEISNTFSFSDTNNNIYNLNNANVCSIT

SEQ ID NO: 4712 - protein, 430 aa, Staphylococcus epidermidis
DMDDINLFPFAGLQIFLMIWVTKVIINMKFNFRDYIIVFTIVIPSAIMYYFWQSKALIVLVIIIIIFFYTKIKLYSILVVLFTTMILYITNFITVYIHLTIKDYIPFKFVLQLIHFTFFVIITLIIAYLTQLLFNKLKVSYLSLNKRYLFIITIVLFISFILLYMVSQTDMRGNDTLKLYAILLMGIMVFLSVVILVMSNFTLREMRYKRNVKEIEAYYEYTLRIESINNEMRKFRHDYVNILTTLSDYIREDDMPGLRKYFNENIVPMKDKLKTRSIKMNGIEKLKVREIKGLITTKIIQAQEKRIPISIEVPDEIDRIDMNTVELSRIIGIIVDNAIEASENLEEPLINIAFIDNEEAVTFIVMNKCSDDIPKIHELFEQGFSTKGDNRGLGLSTLKELTDSNENVLLDTVIENGYFVQKVEINNKES

SEQ ID NO: 4713 - protein, 363 aa, Staphylococcus epidermidis
CLRFIIHWRRRGDLQMNHYIRAIGSMLILVYSMLIAFLFIDKVFVNIIFFQGMFYTQIFGIPVFLFLNLLIVLLCIIVGSVLAYKINQQNDWIISQIERSIEGQTVGINDQNIELYTETIDIYHTLVPLNQELHRLRMKTQNLTNENYNINDVKVKKIIEDERQRLARELHDSVSQQLFAASMMLSAIKESKLEPPLNQQIPILEKMVQDSQLEMRALLLHLRPIGLKDKSLGEGIKDLVIDLQKKVPMKVVHEIQDFEVPKGIEDHLFRITQEAISNTLRHSNGTKVTVELFNQEDYLLLRIQDNGKGFNVDEKFEQSYGLKNMRERALEIGATFHIVSLPDSGTRIEVKAPLNKEENSSGD

SEQ ID NO: 4714 - protein, 157 aa, Staphylococcus epidermidis
EIGEYMISKGEQFPSFSLENQDGNFISNETIKGRKTILYFYPRDNTPTCTTEACEFRDHIEDFNQLDVDIYGISADSKKKHQNFIKKHQLNFDLLVDKDYQLANKVGVYQLKKSFGKENMGIVRTTFILDENGNIIDVIEKVKVKTQIETIKNILEG

SEQ ID NO: 4715 - protein, 342 aa, Staphylococcus epidermidis
SLFEFPFLKRSQYDMNDKWYRHIIGARTIKTGLATFFTSLFCMLLNLTPIFAILTAIVTIEPTAKASLKKGYKRLPATVIGALFAVVFTYVFGDQSPLSYALSATFTILICTKLNLQVGTTVAVLTSVAMIPGIHEAYVFNFFSRLLTALIGLVTAGLVNFIILPPKYYHQLEEQLALSEKKMYRLFYERCNELLLGKFSSEKTSKELSKLNIIAQKVETLMSYQRDELHYHKNEDNWKLLNRLTNRAYNNRLFISHLSNIIYLPKHTSIAFDANEKIALINISNSINGIIQKGSFARQKKSIATLKSSVKQMDEFDQNQMKSTLIYEILLIYKILDSRYAK

SEQ ID NO: 4716 - protein, 104 aa, Staphylococcus epidermidis
GLFEMQIEKLRGQSLDELFDAILALENREECYQFFDDLCTVNEIQSLSQRLQVAKMIKQGYTYATIEEESGASTATISRVKRSLQWGNDAYTMILDRLNIETKA

SEQ ID NO: 4717 - protein, 423 aa, Staphylococcus epidermidis
DSLDKIWRINMTNYHNKLKQYAELLVRVGMNVQPQQPVFIRSSVEALELTHLIVEEAYKAGAEDVRVSYTDPKLKRLKFENESVEHFEKQELKQYDIEERLDYVNRGAANLALIAEDPELLNGIDAQKLKAYQTVYSKGFKPYMEASQKNQFPWVVAAFPTRDWARRVYPELDVESAYIKFIDEVFDIVRVDGQNPIENWEKHIKDLSVHAKRLQEKNYQALHYISEGTDLIVGLPKGHIWEDATSYVNGDGQPFIANIPTEEVFTAPDRNNVNGYVTNKLPLNLNGNIIDGFTLTFKDGVIIDVKAEKGEKLLKDLIATDEGACRLGEVALVPDDSPISNRRTIFYNTLFDENASCHLAIGSAYSFNIKGGTEMTTEEKIANGLNDSNIHEDFMIGSPDLTIYGILQDETKELVFKNGNWAK

SEQ ID NO: 4718 - protein, 355 aa, Staphylococcus epidermidis
MLIDKARSFIQTMYSELKYNTNEVENRMKEIEQEINLTGSYTHTYEELSYGAKMAWRNSNRCIGRLFWGSLNVKDARDVCDEKEFIKFIHTHIKEATNGGKIKPYITIFSPEDTPKIYNNQLIRYAGYENVGDPSEKKVTRLAEHLGWKGKGSNFDILPLIYQLPNDTIKIHELPSDIVKEVSIHHEHYPKLSKLGLKWYAVPIISNMDLKIGGITYPTAPFNGWYMVTEIAVRNFTDTYRYNLLEKVAEAFEFDTLKNNSFNKDRALVELNHAVYHSFKADGVSIVDHLTAAKQFEMFERNEHQQNRDVTGKWSWLAPPLSPTLTSNYHHGYDNTMHHTNFFYKKEEPMKCPFH

SEQ ID NO: 4719 - protein, 105 aa, Staphylococcus epidermidis
FVIEQYFLRDGKFVQDVDMKDGGPEDSTILTLQKDDFNKALDSLSENFKVQQSQKESGEIIIKAQNDYRELLKSLSQLDIYPKYIETRKSSLRDTYFNINQRGDK

SEQ ID NO: 4720 - protein, 247 aa, Staphylococcus epidermidis
NEQDKKNFYKQIKKKEVCIMTTTTYQGTSQDVWNVLFDNRKYKGLLDEVNKLIEDTKRLYKQGYRLEAIDEQQKPKVTELENKFKQFATDRLNEIEQRCNEIEKESQQDNVKDPQTEIIKRQNLEARLSFYNDNEIVDYINSKDVTSTDIYELSLLQQKYDNQLNESQQRQVAFKLEELKQGVLYPYTTNEEYKNLMFEYSVINQTGMAKTGVVITKNEQYGGVEIKQLTERYKNAINEVKQSNNRR

SEQ ID NO: 4721 - protein, 326 aa, Staphylococcus epidermidis
AFMDTATHIVMGVGLTALATQDPVMAESFAATATTLIAGSLIPDGDTVLKLKDNATYISHHRGITHSLPFTILWPILITFFIFVIFSQTNPLHVWLWAQLAVFLHVFVDIFNSYGTQALRPITNKWIQLSVINTFDPIIFIILSTGVLLWILGIHPYIVFFPIILILIGYYIVRFKMQAAIRKQALQKIEQSHTPVKVFVAPTIKFHVWRVAIQTDKHDYVGVSKWKNVDFTDKVKRQSMTPDSILWKVKGNKDIYTFLNFSSIYRWQTTPLDDGTTEIRLMDLRYLNKGRYSFVAIAHLTLENEIDHSYIGWVFSEDKLQRKLFS

SEQ ID NO: 4722 - protein, 150 aa, Staphylococcus epidermidis
VSAELESIDHELEESIASLRKAGVRITPQRQAIMRYLISSHSHPTADEIYQALSPKFPNISVATIYNNLRVFKDIGIVKELTYGDSSSRFDFNTHNHYHIICEKCGKIVDFHYPQLDEVEQLAQHVTDFDVTHHRMEIYGVCKECKEEGN

SEQ ID NO: 4723 - protein, 258 aa, Staphylococcus epidermidis
FIKERDKMIVKTDEELQALKEIGYICAKVRDTMKEATKPGVTTRELDHIAKDLFEEHGAISAPIHDENFPGQTCISVNEEVAHGIPGKRVIHEGDLVNIDVSALKNGYYADTGISFVVGKSDQPLKQKVCDVATMAFENAMKKVKPGTKLSNIGKAVHATARQNDLTVIKNLTGHGVGQSLHEAPNHVMNYFDPKDKTLLKEGQVIAVEPFISTHATFVTEGKNEWAFETKDKSYVAQIEHTVIVTKDGPLLTTKIDD

SEQ ID NO: 4724 - protein, 398 aa, Staphylococcus epidermidis
KAKEIVMSKKEKTTSKYLNSIEDKEHKKNKKIEVDRTYIEPQEFQSKKPKKKNQVFFVSRLNKPAKYTENSNFFSYLIYRIGKDDAAGLAAQMTYHFVLALFPMLIFLLTLLGQFITIDANQINQKVSQYVPDQETASIVGGIVKDISDTASGGILSVGLILAIWSASNGMSAIINSFNVAYDVEDSRNGVVVKLLSILYTLVLSAVFVVAVVLITLGPVINKFLFGPLGIDNQIEWIFNLVRIVIPLIIIFIIFTVLYSVAPNVKTKLRSVIPGAIFTSIIWLLGSFAFGYYISNFSNYSKTYGSLAGIIILFLWLYITSFIIIIGAEINAIIHQRKVIAGHTPEEAAIKHDDNNENHYNENTTYEYYEDSKDVDISNEDDTYNINHQSKEEHHTSD

SEQ ID NO: 4725 - protein, 65 aa, Staphylococcus epidermidis
KDELTNYRCCYTSFMNFYRLLLQYKIFYSYLHLFCLIISNFFITFFPYLYKVRSKRPLFLFYPLL

SEQ ID NO: 4726 - protein, 207 aa, Staphylococcus epidermidis
GGRLMNAIELKDVNYRSNAFQLQDVSFNVPKGYVTGFIGGNGAGKTTIIRLIMDLIQSESGTISVFEKDIKIHPREIKNKIGFVYSEIYFNQKWTVKKLENIIAPFYDRWDHEIFIKYLKFFQLPYKNKIKTFSTGMKMKLSLAIAFSHHAELFILDEPTSGLDPLIRNELLEIIQQELIDENKTVFFSTHIISDLEKIADYIVFSQ

SEQ ID NO: 4727 - protein, 491 aa, Staphylococcus epidermidis
LILRLISNKIITTSNLRLGMPHIIFLTFLYVGGKKLETIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPGVVMVDPPRKGCDETFLTTLLKLNPKRIVYISCNPSTQQRDAQILAEQYELVEITPVDMFPQTTHIETVALFVRKDEE

SEQ ID NO: 4728 - protein, 729 aa, Staphylococcus epidermidis
MNALVKNMNSEQSEAVRTTEGPLLIMAGAGSGKTRVLTHRIAYLLDEKDVSPYNILAITFTNKAAKEMKARVEHLVGEEAQVIWMSTFHSMCVRILRRDADRIGIERNFTIIDPTDQKSVIKDVLKSENIDSKRFEPRMFIGAISNLKNELKTPEDAQKEANDFHSQMVATVYKGYQRQLSRNEALDFDDLIMTTINLFERVPETLEYYQNKFQYIHVDEYQDTNKAQYTLVKLLANKFKNLCVVGDSDQSIYGWRGADIQNILSFEEDYPEAKTIFLEQNYRSTKNILNAANEVIKHNSERKPKGLWTANSGGDKIQYYEAMTERDEAEYVVKEIMKHQRSGKKYSEMAILYRTNAQSRVLEETFMKSNIPYTMVGGQKFYDRKEIKDLLSYLRVIANSNDDISLQRIINVPKRGIGPSSVEKIQTYALQNNISMFDALAEVDFIGLSKKVTQECISFYEMIQNLIKEQEFLEISEIVDEVLQKSGYRDMLDREQSIESRSRLENLDEFMSVPKDYEENTPLEEQSLINFLTDLSLVADIDEADTQNGVTLMTMHSAKGLEFPIVFIMGMEESLFPHIRAIKSEDDHEMEEERRICYVAITRAEELLYITNATTRMLFGRSQSNMPSRFLKEIPEDLLDSHTGQKRQTIYPKSQPKRGFSKRTTSTKKQVSSSDWKVGDKVMHKAWGEGMVSNVNEKNGSVELDIIFKSEGPKRLLAQFAPITKKEDS

SEQ ID NO: 4729 - protein, 268 aa, Staphylococcus epidermidis
NDRRVNILKIQILQFNVERGNVDKNMQNIKTKFNQYLDKDTSVVVLPEMWNNGYALEELEQKADKNLKDSSLFIKDLAHTFNVDIIAGSVSNIRENHIYNTAFAINKNKELINEYDKVHLVPMLREPDFLCGGNVVPEPFYLSDQTLVTQIICYDLRFPEILRYPARKGAKIAFYVAQWPSSRLDHWLSLLKARAIENDIFIVACNSCGDDGHTNYAGNSIVINPNGEILGHLDDKEGVLTTHIDVDLVDQQREYIPVFRNLKPHLYK

SEQ ID NO: 4730 - protein, 582 aa, Staphylococcus epidermidis
EGRRMIKRYLKFVKPYRYRIIATIIVGIIKFGIPMLIPLLIKYAIDGVINNHSLTNQEKFSHLGVAIGIALFIFLIVRPPIEFIRQYLAQWTSNKILYDIRKQLYNHLQALSVRFYANNQVGQVISRVINDVEQTKDFILTGLMNIWLDCITIIIALSIMFFLDVKLTFAAIFIFPFYILTVYFFFGRLRKLTRVRSQALAEVQGFLHERVQGMSVIKSFAIEDNEAKNFDNHNKNFLQRAFQHTRWNAYSFAAINTVTDLGPIIVIGVGSYLAITGSITVGTLAAFVGYLEQLFGPLRRLVSSFTTLTQSFASMDRVFQLMDEDYDIKNGIGAQPIKISKGQIDLKHVSFKYNENEKEVLHDINLTINKGETVAFVGMSGGGKSTLINLIPRFYDVTQGEILIDHHNVKDFLTGSLRNQIGLVQQDNILFSDTVKENILLGRPDATDDEVVEAAKMANAHDFISNLPNGYDTEVGERGVKLSGGQKQRLSIARIFLNNPPVLILDEATSALDLESEAIIQEALDVLSKDRTTLIVAHRLSTITHADRIVVMENGRIVETGTHQQLINKRGAYEHLYSIQNL

SEQ ID NO: 4731 - protein, 137 aa, Staphylococcus epidermidis
SLISDEVISLNILDLYLQQFIKRITKKSINDYKMSLDKQIKNIDTYINYLREKRLQLKKLIDTLTLSLENKYIDLVNNQAIYCAEEIHDNDIDMIKSQLNDAESYYARIEADINLQSRMKITTEEAFHFIYHMSAVA

SEQ ID NO: 4732 - protein, 196 aa, Staphylococcus epidermidis
MGRLILVIRSDDMDKLTPKQERFANEYIKTLNVTQSAIKAGYSPNSAHVTGSRLLRKEKVDKYIKSKKDEIMDDTILSAKELLYLLTQAAVGDETETKEAVVKKGTFERNPDSGRMNLVYNEHVETVEIPIKPSDRLKARDLLGRYHSLFTEKVDLNVATPVFIDSIDEDDEKNERDIENLSKQYPNAEFHIDDIR

SEQ ID NO: 4733 - protein, 506 aa, Staphylococcus epidermidis
LMGSSIVLKLLKVTHYYRNHNSKKWYRPLGYDAEDINLNNISLHIYQGEALGIIGEPGSSKTLIGRILSGSVKPDKGKVVRTKNLYFGDIDDRKINNLTVSQYVSELVQLFPYEVTEHKVEQIIQWAHLGDYIEEKVSNLSEKSYAQLLLSIARSSKNDIIILNHVLSHLDETFIERATVLSKDYIEANKTLVLIDNDVEKISKTSNYITWVSHGQIRKEGSLNQVLPTFREHEKDRTSLKSEMEIENFDYDWKQNRSRIPEMTYNFKRIERYNHAKPPRFLVRFWTLFVSFLIGLVLMSVLFFNNLGMVKLGNINTQASIQNQNKDTYEEKLAYGLALDGSVTLNGSKDLKVPKYSLITITGENNKRYRVEMNQRRYSVSKNQVFYFNPAGLYESHTFKKLSPYIKSNYSTYVEYFNSHLHQKHDKVTETLRPDKDKKYVVPITQQPIKMIFGDNDKLSGFVIPMTNKTELKKTFNITKDVWITKSGSGYFIADMKEEKWIYIEL

SEQ ID NO: 4734 - protein, 193 aa, Staphylococcus epidermidis
FRLRACVNMDKITFLNELELALDDLPREEKDSIMHKYENLFYEEELKGISESQIIKKLNDPYHISKEVKARSAIHYASYKPTLANIVRAILASLSLGILSLFIILIPVVIIALLILFCFLISICFIFAPFVLLFYSVLHGFENAISNVFFSISFTGLGIMFIVITLKIGEIIHKLILKYLLWYIKTVKGSVKE

SEQ ID NO: 4735 - protein, 244 aa, Staphylococcus epidermidis
IMKSLQLVKYDLISILKSPYTYLAFILVIGMTVFQASMMANYSSAHKVNIDMVFNLANWLFLFAGLLFIIKTITRDYSQGTIQLFMSRITSRMGYIITKTVSIVLISFLFTIIHYLVIIIIQSTTKSEKMDGDRFLNNIWFYLIFFLFFGLFLLLITLIVEKPAVIFTLGIFLILIVPFIQPFIPMIPNIGDDIQDSFKYIPFTYLTEKMTGEIKFSNWQWFISIASIVVLFIANMLYASKRDI

SEQ ID NO: 4736 - protein, 215 aa, Staphylococcus epidermidis
IRRRIQVAIKVLFVDDHEMVRIGISSYLSTQEDIEVVGEGASGKDAITKAHELKPDLILMDLLMDDMDGVEATTEIKKDLPQIKVVMLTSFIEDKEVYRALDSGVDSYILKTTSASDIADAVRKTYEGESVFEPEVLVKMRNRMKKRAELYEMLTEREMEILLLIAKGYSNQEIASASHITIKTVKTHVSNILSKLEVQDRTQAVIYAFQHNLIQ

SEQ ID NO: 4737 - protein, 68 aa, Staphylococcus epidermidis
YLGGKMIKLTNPAVTSPIRAVSNREKKLNTYASCIPGIIATEVNTATVVPTCKLSLVHIRMVNVALKA

SEQ ID NO: 4738 - protein, 167 aa, Staphylococcus epidermidis
YNILNYSREGFYIRNLETYFNKSQTLNEFINKIQESKDNLLSIYNFFHLPLNDARLNQLRESNYYKVLIIKEDWCGDAMMNIPILKHTIEFLNIIARVFHRDDDTHLIDQYLTNGKSRAIPIFVFMNDSFEQLTVWRPRAKKYKVLSIKLEVINCQIKPILILIFTQ

SEQ ID NO: 4739 - protein, 666 aa, Staphylococcus epidermidis
GMQGVKKRVEKLHDLLNQYSYEYYVQDNPSVPDSEYDKLLHELIEIEEKYPEFKSTDSPTVRVGGEAQSSFEKVNHDTPMLSLGNAFNEEDLRKFDQRIRDSIGKVEYMCELKIDGLAVSLKYENGRFVQGLTRGDGTTGEDITENLRTIHAIPLKIKEPLNFEVRGEAYMPRRSFIHLNNEKEQNGEQPFANPRNAAAGSLRQLDSKLAAKRKLSVFLYSVNDLTEFNATTQSEALEELDQLGFKTNQERERVSDIEGVLNYIEKWTSKRGSLSYDIDGIVIKVNDLSQQEEMGYTQKSPRWAIAYKFPAEEVITKLLDIELSIGRTGVVTPTAILEPVKVAGTTVSRASLHNEDLIHERDIRIGDSVVIKKAGDIIPEVVKSILDRRPNESEIYHMPTHCPSCGHELVRIEGEVALRCINPKCQAQLIEGLIHFVSRQAMNIDGLGTKIIHQLYENQLIKDVADIFYLKEEDLLPLERMGKKKVDNLLLAIEKSKEQSLEHLLFGLGIRHLGVKASQVLAERYETMDQLFKVTESELIEIQDIGDKLAQSVVTYLENSDIRSLIEKLSNKNVNMSYKGIKTTEIEGHPDFSGKTIVLTGKLEQMTRNEASEWLKMQGAKVTNSVTKSTDIVIAGADAGSKLAKAEKYGTEIWTEAAFIEKQNGI

SEQ ID NO: 4740 - protein, 273 aa, Staphylococcus epidermidis
FKRGGIMHLYYLGPKGTFSYLAAKQFESHEQYDFIPLSNLHEVIQSVSKDKQAVGIVPIENSIEGTINIVADSLAHHDVYAHGEIQLDIDFSLYGHHSNSLDDIHKVYSIAPAISQTINYIHRQQFDYDYVDSTIQSLNMIKDGIGAIAPLGSGETYGYHTLDQHIQDYPHNVTRFLVVKNHTHFIEHPNTTIFLITPKYDKPGLLASVLNTFTLFNINLSWIESRPLKTQLGMYHFYVQADTAINNDVNKIISILETLDFQVKIIGAFNKKN

SEQ ID NO: 4741 - protein, 186 aa, Staphylococcus epidermidis
RTGGVNVHKIDLSGNKFQIQRFVLLQIVLALFTILFTYKWAYQTTHIIEQNLVMNLIFGFVGFAVLVILHEFIHRILFIIFSKGEKPSLKYDKNKIIVQFSQTCFHRWQFTIIMIAPLVIISATLLALIQIYSFSSLIFMFSIHTSYCMIDVFLVALALQSKFKYIQTYGEGLYLYHQKPTQTYYE

SEQ ID NO: 4742 - protein, 348 aa, Staphylococcus epidermidis
FYGGFGMTLGYIGSYTKKSGKGIYRFKLNDETGVIEALETGYEIEASTYLTRNESFLYAITKEGEECGVASFSIKEDGQLELINKCLASKQGTGCYIQVSSNGKYLFEAVYGAGLARIYKLNPITGAIEKLIEELEHEFPTGSHERQDSSHVHFLNETPDHKYVVATDLGTDRVVTYKFGEDGLKQYAVSQFKNSDGPRHIAFSNDGRHAYIVHELSNEVSVTEYQDGKFIELERHSTIPSDFNGESKLAAVRLSHDGKHLYISNRGHDSIAIFEVLEDGRSLRSIEIQPSYDAFPRDFNITESDNYLICAHQEGESKVSIFERDNITGKLSLKDKKAIANEGVCVLL

SEQ ID NO: 4743 - protein, 187 aa, Staphylococcus epidermidis
IEMGKLGQQIIGYHCNDEVKIDKFKNREVSLLISYEDDIWLGNGMYFWENKSNLDYWKRNRERNYPDKNFSSVEVMLSLDFLLDLSDKEHRKFCKKVLSDLIERGKDNGIDESIFNNDLGEVINVLFSKTDILASHFNVLRTHGLYNWSEDKFLVGNDNKYQSVNRPTSNVKTIYCVKNERAILEIL

SEQ ID NO: 4744 - protein, 518 aa, Staphylococcus epidermidis
LIKGVLIMLTLGTALSNQIDANWQTYVMIIVYFIILLIIGFYGYRQATGNLSEFMLGGRSIGPYITALSAGASDMSGWMIMGLPGSVYSTGLSAIWITIGLTLGAYINYFVVAPRLRVYTEIAGDAITLPDFFKNRLDDKKNIIKIISGLIIVVFFTLYTHSGFVSGGKLFESAFGLNYHAGLLIVAIIVIFYTFFGGYLAVSITDFFQGVIMLIAMVMVPIVALLKLNGWDTFHDIAQMKPTNLDLFRGTTVLGIVSLFSWGLGYFGQPHIIVRFMSIKSHKLLPKARRLGISWMAVGLLGAIGVGLTGISFISERHIKLEDPETLFIVMSQILFHPLVGGFLLAAILAAIMSTISSQLLVTSSSLTEDFYKLIRGSDKASSHQKEFVLIGRLSVLLVAIVAITIAWHPNDTILNLVGNAWAGFGAAFSPLVLYSLYWKDLTRAGAISGMVAGAVVVIVWISWIKPLATINAFFGMYEIIPGFIVSVLITYIVSKLTKKPDDYVIENLNKVKHVVKE

SEQ ID NO: 4745 - protein, 238 aa, Staphylococcus epidermidis
MKIFVCEDDQRQREHMVSIIKNYIMIEEKPMELALATNDPYEVLEQSKELNDIGCYFLDIQLEADMNGIKLASEIRKHDPVGNIIFVTSHSELTYLTFVYKVAAMDFIFKDDPSELKMRIIDCLETAHTRLKLLSKESNVDTIELKRGSNSVYVQYDDIMFFESSTKSHRLIAHLDNRQIEFYGNLKELAQLDERFFRCHNSFVINRHNIESIDSKERIVYFKNGENCFASVRNVKKI

SEQ ID NO: 4746 - protein, 69 aa, Staphylococcus epidermidis
DNIIVVNTSKKEFQYLMSEQQTIDQIKTRLNKFIEDIDHVNPDEVRVEDIDEWIGLLDQLEEKVKQVSK

SEQ ID NO: 4747 - protein, 175 aa, Staphylococcus epidermidis
CHIMAKKVAIILADEFEDIELTSPKEALENAGFETEVIGDTANHEVVGKHGEKVTVDVSIADAKPENYDALLIPGGFSPDHLRGDEEGRYGTFAKYFTKNDVPTFAICHGPLVLVDTDDLKGRTITGVINVRKDLSNAGANVVDESVVVDNNIVTSRVPDDLDDFNREIVKKLEA

SEQ ID NO: 4748 - protein, 222 aa, Staphylococcus epidermidis
DLTMKQLMIRNLKLRTWTLIIYALLLLFFPIYHLLNKDTPLYSIISGPIGLILTMICLIDIGHLFRVNRRLRGSSSYYFFYSLPVSKRDLLNANYMTCILLTFIGELIISLYGYYTSTIKTDSIYFSTTFSFIVGNFFSIPIAFSKSTERKDRDIPYIAYIVGIMVVLPFTLSVIFILINYLTHNDSHIPMIYSYFLNYGLLVVSSIFLVINYLIQIKKIKY

SEQ ID NO: 4749 - protein, 466 aa, Staphylococcus epidermidis
FFYILELTKDCNGEVVEFMKKFNIKHSFMLTGFAFMVTTSLFSHQAHAEGNHPIDINFFKDQIDRNTAKSNIINRVNDTSRTGISMNSDNDLDTDIVSNSDSENDTYLDSDSDSDSDLDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNINHNINHTRTSGDSAPFKRQQNIINSNLGHRNQNNINQFIWNKNGFFKSQNNTEHRLNSSDNTNSLISRFRQLATGAYKYNPFLINQVKNLNQLDGKVTDSDIYSLFRKQSFRGNEYLNSLQKGTSYFRFQYFNPLNSSKYYENLDDQVLALITGEIGSMPELKKPTDKEDKNHSAFKNHSADEITTNNDGHSKDYDKKKKIHRSLLSLSIAIIGIFLGVTGLYIFRRKK

SEQ ID NO: 4750 - protein, 166 aa, Staphylococcus epidermidis
DGHINTWFGVILMIHVAFVCLGNICRSPMAEAIMRQRLQERGISDIKVHSRGTGRWNLGEPPHNGTQKILQKYHIPYDGMVSELFEPDDDFDYIIAMDQSNVDNIKQINPNLQGQLFKLLEFSNMEESDVPDPYYTNNFEGVFEMVQSSCDNLIDYIVKDANLKER

SEQ ID NO: 4751 - protein, 608 aa, Staphylococcus epidermidis
INNITIVIFASIVYYKYLKEGVEMAKLLIMSIVSFCFIFLLLLFFRYILKRYFNYMLNYKVWYLTLLAGLIPFIPIKFSFFKFNNLNNQEPTVESNSHNLNPNINTTKPVHEFTTDIHKFNWDSIDNICTVIWIVLVIILSFKFLNSLLYLKYLKKQSLYLNEKEKDKINKILFNHQYKRNIVIRKAESIHSPITFWYGKYIILIPSLYFKSINDKKLKYIILHEYAHAKNRDTLHLIIFHIFSIAMSYNPLIQIVKRKMIHDNEVEADRFVLNNINKNEFKSYAEAIMDSVLKTSFFNKNILSHSFNGKKSLLKRRLINIKEGNLKKQSKLILIFICIFTFFIMIIQSQFLMGQSLTDYNYKKPLQSDYQILDESKNFGSNSGSFVMYSMKKDKYYIYNEKESRKRYSPDSTYKIYLALFGLDRHIISDKNSRMSWNHNHYPFDSWNKDQDLNTAIQNSVNWYFERISNQLSKNYTSDQLKQLNYGNKNLGSYKAYWLEDSLKISNLEQVIVLKNMMEQNNHFSKNEKKQLSSSLLIRKNENYELYGKTGTGIVNGKYNNGWFVGYVITNHDKYYFSTHLSDEKASGENAKFINEKILKEMGVLNGQ

SEQ ID NO: 4752 - protein, 355 aa, Staphylococcus epidermidis
SKNIRRDYKMQKVRSDIMTHRGSHYDLGVKTALWLQTTPLLKNRNKEWRKRIPRFDIDVKETYDIFQIYSPQIWEEIIGMQDVLNLPTKQMILNFGHYRFTDLKDSGCTVYKGRDFLVRNYDYHPATYDGRYLLFQPNDGGLSQIGPTSRVTGRMDGMNEYGLVMAYNFMHRKKPANGFVCYMVGRLILENCKNVTEAIKFLKEVPHRSSFSYILMDRHSNYAIVEVTPRSIDVRYEHICTNHFELLTHENRNYTRESKERLNRVINKTTPSTNKDIAFKLFNDPQYEIYSNLFKSWSGTIHTSLYEPNSLIAWMALGQNSHPTSINFSNWLKGKKLNINYFEGEIDTPLTFATY

SEQ ID NO: 4753 - protein, 128 aa, Staphylococcus epidermidis
NKSIEVKMEKFNRQEQLKQLHAERKVKTEKKVDKAINDLVQKNKEINFNIVSKHSKVSKATLYKNNKIRKKIEKLREQNREIFVHKNKNDGKDALISSLKRKVNSLEKEKKMLKEEISVLYSRLYEDI

SEQ ID NO: 4754 - protein, 460 aa, Staphylococcus epidermidis
LRIFFVIPFTCYNYSSANWRRKRMRQWTATHMAKLARKASIAVGKKGTDLPGQIARRVDHNILRKLAKQVDDIVFISGTNGKTTTSNLIGHTLKKNQINIIHNNEGANMAAGITSAFIMQSSKNTNIAIIEIDEGSIPRVLNEVTPSMMVFTNFFRDQMDRFGEIDIMVDNIAKSISNKGIKLLLNADDPFVSRLKIASHSIVYYGMKKFAHDFEQSTMNESKYCPNCGRLLQYDYIHYNQIGHYHCECGFKREEPTYEVSSFDASPFLKMIINQSEFNMKIAGDFNSYNAIAAYTVLRELGLNDDAIRKGFETYTSDNGRMQYFSKNKKEAMINLAKNPAGMNASLSVGEQIDDKKIYVISLNDNAADGRDISWIYDADFEKLATQDIEAIIVSGTRAEELQLRLKLAEVEVPIKVEKDIYKATALTMKYSSFTVAIPNYTSLTPMLEQLNRSFEGGQS

SEQ ID NO: 4755 - protein, 101 aa, Staphylococcus epidermidis
SDLIKYLDQIYEIKSDIIIIKIIDKHQFSLAESTKSLNHLIFLFLYIYAYIIIARSIIIFINLMLLLSTFFNFSVGLQKSINTVYELSNIYVKNKGIIKKR

SEQ ID NO: 4756 - protein, 285 aa, Staphylococcus epidermidis
CVIIYVRKTFEYRSRDSKMPKVTKIEVQKKNKERFNLFLDGEFEMGIDIDTLVKFNLKKDQILEPSDMQNIQEYDHYRRGVNLAIQYLSYKKRTEREVIQYLEKNDIQSNAIQDVIDYCYKEKFIDHEDYAESLKNTMIHTTDKGPEIYRQKLYQLGIEVTIIEKYVEAYEQQQPLDDVIKVAEKVMKSKKGPEAKVKQKVTQSLLQKGYKFETIQLVMNEIDFSQDEETLDHLLQRDLEKVYNKNCRKYDSDKSVIKTIEALMRKGYNYDKIKSKLEESGISNE

SEQ ID NO: 4757 - protein, 193 aa, Staphylococcus epidermidis
RKIIERNEIMVQNAFVALDFETANSKRTSICSVGMVKVIDNQITESFHTLVNPFDYFTETNITVHGIHPEDVQDAPGFKHVYPYMLKFIDQLPVVAHNAAFDMNVLHQSLKSHNIDTPSLTYFCSYQLAKRTINAYRYGLKHLMNHYHLDFHGHHDALNDAKACAMITYRLLKHYDDLQSMLSIYGKNLKDKG

SEQ ID NO: 4758 - protein, 381 aa, Staphylococcus epidermidis
IMIISNKSPISINNDPWEAYNDILEHNQLTLSNIEFTTTNLCNMRCSHCAVGYTLQTKDPDPLPMDIIYRRLDEIPNLRTLSITGGEPMFSKKSIKNVVKPLLKYAKHRGIYVQMNSNLTLPQDRYLDIAEYIDVMHISHNWGTIQEFTDVGFGAMRKQPPLKAKLKLYEQMLENSSTLSDQGMFVSAETMLNQSTVPYLSKIHNEVVNDMKCSRHEIHPMYPSDFASQLNVLSLKEMKEAIHHLLDIRDENTWMLFGTLPIYPCLNDEYDQHLLQRLRKSKNVTMRNDPDGRSRLNVNVFTGDVIVTDFGDENGTISNIQKDKLTDVFNQWLNTDLAQSLNCHCAEYQCLGPNVLVKNMYYPNTDFKKKEQIMHQHQIFS

SEQ ID NO: 4759 - protein, 479 aa, Staphylococcus epidermidis
GVEIMHFETVIGLEVHVELKTDSKMFSPSPAHFGAEPNSNTNVIDLAYPGVLPVVNRRAVDWAMRASMALNMDIATNSKFDRKNYFYPDNPKAYQISQFDQPIGENGYIDIEVDGETKRIGITRLHMEEDAGKSTHKDGYSLVDLNRQGTPLIEIVSEPDIRSPKEAYAYLEKLRSIIQYTGVSDCKMEEGSLRCDANISLRPYGQKEFGTKTELKNLNSFNYVKKGLEYEEKRQEEELLNGGEIGQETRRFDESTGKTILMRVKEGSDDYRYFPEPDIVPLYVDEDWKARVRETIPELPDERKAKYVNDLGLPEYDAHVLTLTKEMSDFFEGAIDHGADVKLTSNWLMGGVNEYLNKNQVELKDTQLTPENLAGMIKLIEDGTMSSKIAKKVFPELAENGGDAKQIMEDKGLVQISDEATLLKFVTDALDNNPQSIEDYKNGKGKAMGFLVGQIMKASKGQANPQKVNSLLKQELDNR

SEQ ID NO: 4760 - protein, 359 aa, Staphylococcus epidermidis
GESMTERRIIHIDMDYFFAQVEMRDNPKLKGKPVIVGGKASHRGVVSTASYEARAYGVHSAMPMTQAHKLCPNGYYVTSRFDTYREVSGQIMKIFRSYTELVEPMSLDEAYLDITHLVRPDLPASTIANYIRRDIYEVTSLTASAGVSYNKFLAKLASGMNKPNGLTVIDYNNVHEILMQLDIGDFPGVGKASKKKMHQHHIYTGQDLYNKDEFELIRLFGKRGRGLYNKARGIDHNEVKASRVRKSVGTERTFSTDVNDDDVILRKIRELSGKTAERLNKIQKSGKTVTVKIKTYQYETISKQKSLRDPIRTETDIYNIAYTLYNDLKDPEIPIRLIGVTVGSLEQSDFKNLTIYDFI

SEQ ID NO: 4761 - protein, 144 aa, Staphylococcus epidermidis
ISFVLPVSGNLSCTSLLLSFLEVVVISSSLSFLVIFVSFSSLPLFGITGLFSSLSFFKVFVIFFSLSFFGVFVSSSFSTLPLLGITGFFSSLSFFGVFMSFFSLSFFGVFVSLDSFSSLSFFSVFVSSSFSFLVICVFVTEVFA

SEQ ID NO: 4762 - protein, 300 aa, Staphylococcus epidermidis
ALNVGKISISVFLKLLNTLKRWRMKMSRLQDVVVNEMKVKKQIDSVEEIQEIKQFIKAYVKSHSFIQTLVLGISGGQDSTLTGKLAQLAVNELKEEGRNCKFIAVKLPYGVQQDAHEVEDALEFINPDTTYTVNIKPAVDQSVQSLSEAGIKLTDFQKGNEKARERMKVQFSIASNTQGIVLGTDHSAENITGFYTKYGDGAADIAPIFGLNKRQGKQLLAYLGAPKHLYEKVPTADLEDDKPQLPDEEALGVSYHDIDDYLEGKEIPGTARETIEKHYVRNAHKRELAYTRYSWPKYNK

SEQ ID NO: 4763 - protein, 281 aa, Staphylococcus epidermidis
IVGVKMIDNLIVYIKNLPHLFSFCTQRLKQTWKWFAISLIIGLVIILALEGFFNFNHTTDIVQVRWLFRISSFIIFSIIIQSIYIAYKYYIRDFVVMKSFHISAVTPTIVIAMLGLITILILGIVIIILKPVNFEASILSFLYYLVILAIFISVTSIILGLLSYAIKHVKLIFIIVSAISFFMVPITYIPNTNLNVVNHIMMLNPLYYFVNGSSQAIVFGTISMSNLPYHLYIIILIGIICVINYALVRHIAFDKYQNQSNQKNYSKKNKEKECLNVKLDK

SEQ ID NO: 4764 - protein, 258 aa, Staphylococcus epidermidis
HQCLNNLIAHLKEGNRKMNELTVYHFMSDKLNLYSDIGNIMALKQRAKKRNIKINVKEINETEGVTFDDCDIFFIGGGSDREQALATKELSKIKTSLKNAIEDGMPGLTICGGYQFLGHKYITPDGTELEGLGVLDFYTESKKERLTGDIIIESDTFGTIVGFENHGGRTYHPYGTLGRVTYGYGNNDNDRKEGIHYKNLLGSYLHGPILPKNHEITDYLLEKACERKGILFEPKKIDNTEEEAAKQVLIKRAKENKK

SEQ ID NO: 4765 - protein, 118 aa, Staphylococcus epidermidis
IQIVIQIQIVIQIQTVTQIQIVTQIQIVTQIQTVIQTQIVTQIQTVIQTQIVIQIQIVIQIQTVIQIQIVIQTLVQVQVRVHIPEKNLVTLKEIQIDLLKDIRINPKGLNTIKQIKTI

SEQ ID NO: 4766 - protein, 205 aa, Staphylococcus epidermidis
KNKVLTFLRRSMMKLQHITKKYGQNTVLDDIDFDFGESQIVGLIGKNGVGKTTLMKVMNNNIINYQGKVDMPKSENVGYLIEHPKLYGNKTGLFNLKLFAQVLGDGFDKEYANHIIEAFGMKPYIKKKVNKYSMGMKQKLSIAVSLMNKPKYLILDEPTNGMDPDGSIDVLKTIQSLVQQLEMKILISSHKLEDIELICDRAVFP

SEQ ID NO: 4767 - protein, 178 aa, Staphylococcus epidermidis
HLGVEQRYAVIQLKTKYNATFLKSEFDKWEQHIEDMYALHYPRMFIDPYTMQLSYESNHIEDLALSIIEEREKLEKFKHKSNHDLKKFNIILSNYSDSEQRQIKRYQRDDILADESLILRICEDISNIDSKDKNNRNTAIQEEIKADKERRRAEGKARKERIKARMKRARQEKLLQAN

SEQ ID NO: 4768 - protein, 110 aa, Staphylococcus epidermidis
KKAVYLMNKKKMSEMSEQELRHEIQLFKEKMRKAEMNGIMNEYDVYQSKVIIAESYLVDRNKIEPGKIYKLNDGSKQYFKVERLKGVFAWGFRINSSEPEEGLPLALLKF

SEQ ID NO: 4769 - protein, 124 aa, Staphylococcus epidermidis
GYQVFFRYVNPYLNLYQSLNHYLNLNHCLNLNHYLNLNHYLSLNHCLNLSHYLSLNHCLNLSHYLNLSHYLNLSHCLNLNHYLNLNHYLNLSHYLSLNHYLNMCHFLSHYLKRYLYLNHYPNSY

SEQ ID NO: 4770 - protein, 155 aa, Staphylococcus epidermidis
EGLFVFPLGLPGFFPVCEPLPELVPESESLSESESLSESESLSESESLSESESLSESESLSESESLSESESLSESESLSESESLSESESLSESESLSESKSLSESESLSKYVSFSESLFETISVSKSLSEFILIPVRLVSFTRLIILLLAVFLSI

SEQ ID NO: 4771 - protein, 315 aa, Staphylococcus epidermidis
LKILNKKRLIDMKFTESERLQQLSNEYILGGVNSPSRSYKAVGGGAPVVMKEGHGAYLYDVDGNKYIDYLQAYGPIITGHAHPHITEAIQDQAAKGVLYGTPTELEINFSKKLREAVPSLEKIRFVNSGTEAVMTTIRVARAYTKRNKIIKFAGSYHGHSDLVLVAAGSGPSQLGSPDSAGVPQSVAQEVITVPFNDIESYREAIDYWKDDIAAVLVEPIVGNFGMVMPQPGFLEEVYKISHDNGTLVIYDEVITAFSFHYGAAQDLLGVKPYLTAFGKIVGGGLPIGGYGGRQDIMEHVAPFTSSLIQQGTMGG

SEQ ID NO: 4772 - protein, 97 aa, Staphylococcus epidermidis
YIQLNYLSFSHLQFNINPFFFFHISDKITASTFCNPYIFRDIKCFFQFRFICHWNNKSRQFIIITKYHFYRLLRDRYNILFIFIRSKRFCYFIMFLM

SEQ ID NO: 4773 - protein, 473 aa, Staphylococcus epidermidis
KKKLAFYILGCMRIFKIMDNKIEKILEDINKLQGYKVTYQYATAINIKDNNMNPWFEKIEEILLNVKGVIRILSPDNPPVNYDYWILPGRYKRHTKEYHEKLEKFLEKFATNANINDGLFDQNNIHGYKYKKYIFTPHIEITHENTLNLFFLTLTIFNNGTFVIEIIEDLESINFGSDLYSTFSCVKDKIYPLINQEKNNRQRQYQFYGNRHCKNIRDVSRQINRIIKINSKDIFEYKVSKNMGFEVYYLANENEFTDDPFYEDVKIQEWLVNAPIFSFEGKSKHFRQDGYSDNYINFLNKASVFVVWMDEQEEDVLEKCSQMALYFNSSANFFFLETMLNELQLYGYQQYNLNGKKEALYFRQWILNFKRSIAIIYRTELLPSLYLYLYLKNNNDFKSPQYIEELNKEELSLIELEQSYKEEERSEKLNKLLLIISLLSIFQVVEIFFSDKNNIFNISMILIMILLEVFRKR

SEQ ID NO: 4774 - protein, 324 aa, Staphylococcus epidermidis
VYEFEGLTMRKRARIIYNPTSGKELFKRVLPDALIKLEKAGYETSAYATEKIGDATFEAERALESEYDLLIAAGGDGTLNEVVNGIAEQPNRPKLGVIPMGTVNDFGRALHLPSDIMGAIDVIIDGHTTKVDIGKMNNRYFINLAAGGKLTQVSYETPSKLKSIVGPFAYYIKGFEMLPQMKAVDVRIEYDDNIFQGEALLFLLGLTNSMAGFEKLVPDAKLDDGYFTLIIVEKANLAELGHIMTLASRGEHTKHPKVIYAKAKSINISSFTDMQLNVDGEYGGKLPANFLNLEQHIEIFTPKDVFNEELLENDTITDITPDKQ

SEQ ID NO: 4775 - protein, 684 aa, Staphylococcus epidermidis
FIMSKVHLIESPYALDKIKGIGPKRLALLEELNIKSVEDLVLYLPTRYEDNTVIDLNQADDQATVTVQGEVYSSPTVAFFGRNKSKLTVHLMINHIAVKCVFFNQPYLKKKLELNSIVTIKGKWNRNKQEINGNRIFFKDQKNQEDTHLEPIYRIKEGIKQKQLRDNIRQALSDVTIHEWLTDDLREKYKLETLAYTIQTLHHPINKQNLLRARRTYAFTELFMFELRMQWLNRLEKTSDEAIEINYDINKVKQFIDSLPFELTDAQKVSVNEIFRDLKAPIRMHRLLQGDVGSGKTVVAAICMYALKTAGYQSALMVPTEILAEQHAESLIQLFGNTMNVALLTGSVKGKKRRLLLEQLENGTIDCLIGTHALIQDDVVFNNVGLVITDEQHRFGINQRQILREKGAMTNVLFMTATPIPRTLAISVFGEMDVSSIKQLPKGRKPIKTSWAKHEQYDQVLAQMSNELKKGRQAYVICPLIESSEHLEDVQNVVALYESLQSDYGNEKVGLLHGKMSAEDKDQVMQKFSEHEIDILVSTTVVEVGVNVPNATFMMIYDADRFGLSTLHQLRGRVGRSEHQSYCVLIASPKTETGIERMTIMTQTTDGFELSERDLEMRGPGDFFGVKQSGLPDFLVANVVEDYRMLEVARDEAAELIQSGQFFEQQYSHLREFIKQNLRHIRFD

SEQ ID NO: 4776 - protein, 68 aa, Staphylococcus epidermidis
LSTFILCLVRGLLYIFTFIAGATNFGVVVASNVEVIKSSAIPTLNFAIVLAVAGATIIASAQSPNDTC

SEQ ID NO: 4777 - protein, 249 aa, Staphylococcus epidermidis
RHMLNAQFFTDTGQHREKNEDAGGIFYNQTQQQMLVLCDGMGGHQAGEIASQFVTYELQKRFEEENLIEINRAESWLRSNIKEINFQLYNYAQENEDYRGMGTTLVCAIIYDKQVVVANVGDSRAYVINQRQMDQITSDHSFVNHLVMTGQITKDEAFHHPQRNIITKVMGTDKRVSPDLFIKRTHFYDYLLLNSDGLTDYVRDYEIQELLSSNNSLDVHGNELLDLALAHDSKDNVSFILLKLEGDKV

SEQ ID NO: 4778 - protein, 179 aa, Staphylococcus epidermidis
DIMLSVALDDIKKNGGTSLKKKYYISISLLMTIIVLVFDQVSKWLITISMKVGDSYEIIPNFLNITSHRNNGAAWGILSGKMLFFYIITIIILIVLVIFYIKEAQFNLFMQVAISLLFAGALGNFIDRVLHGEVVDFIDTNIFGYDFPIFNIADSSLTIGVIFVIIALIKDAIINKKEV

SEQ ID NO: 4779 - protein, 79 aa, Staphylococcus epidermidis
KNVTGGQKIMLNPPLNQLTAKVNSKYLIATTAAKRARELDEKRETALLDQYHSAKPVGKALEEIADGKIEPVVPKEYLG

SEQ ID NO: 4780 - protein, 187 aa, Staphylococcus epidermidis
RYEFFYIKRGETMSERIILDEAAIQRTITRIAHEILEYNKGTKDLVLLGIKTRGAFLAHRIQDKINSIEQQLVPTGTIDITHFRDDVDKVVQQADQYAFDINVDINNKVVVIIDDVLYTGRTVRASLDAILLHTRPIKIGLAALVDRGHRELPIRADFVGKNIPTARDESVSVYLEEIDDRNAVVIE

SEQ ID NO: 4781 - protein, 303 aa, Staphylococcus epidermidis
IKLYFYRRRFMEHLLSMEHLSNSEIYDLITIACQFKSGERPLPQFNGQYVSNLFFENSTRTKCSFEMAEQKLGLKLINFETSTSSVKKGESLYDTCKTLESIGVDLLVIRDSQNSYYEELDQLNIPIANAGDGSGQHPTQSLLDIMTIYEEYGSFEGLNILICGDIKNSRVARSNYHSLTSLGANVMFSSPKEWVDNTLEAPYVEIDEVIDKVDIVMLLRVQHERHGISGEANFAAEEYHQQFGLTQARYDKLKEEAIVMHPAPVNRGVEIKSELVEAPKSRIFKQMENGMYLRMAVISALLQ

SEQ ID NO: 4782 - protein, 64 aa, Staphylococcus epidermidis
WVDFSHSSSPFNFYHKDYTFLIVNVMLSMTFVKALAVSSDVKQGTPFSTVVRRIWNPSRSISFP

SEQ ID NO: 4783 - protein, 310 aa, Staphylococcus epidermidis
EGGLVLENYNFNIIEQSQVGQRIDKLVSDLNKDWSRSQLQDWIKEGLVKVNGKVIKSNYKVKLNDKIVVTEKEVVEADIKPENLNLDIYYEDEDVAVVYKPKGMVVHPSPGHYSGTLVNGLMYQIKDLSGINGEIRPGIVHRIDKDTSGLLMVAKNDVAHRHLVEQLMSKTVKRKYTALVHGNIPHDYGTIDAPIGRNKNDRQSMAVVDDGKEAVTHFNVLEHFKDYTLIECQLETGRTHQIRVHMKYIGYPLVGDPKYGPKKTLDIDGQALHAGIIGFEHPVTHEYIEKHATLPNDFEKLLDDIRRRDA

SEQ ID NO: 4784 - protein, 244 aa, Staphylococcus epidermidis
VEKQKRTSYTFIIKHYLNSYQSRRIIMPFTPSEIKNKEFTRVKNGLEPTEVANYLEQLSNEIERLKEDKKQLEKVIEDRDSNIKSYKDVHQSVSDALIQAQKVGEETKQAATKEAEAVLSKAQVQADSIVNDAIEKARRLAFQTEDMKRQSKVFRSRFRMLVEAQLDLLKSEDWDYLLNYDLDAEQVTLEDIHHLHDNDLTPEERAMKQKQNQEISANQPSTSSSESVSQSNANNESSQSTSNN

SEQ ID NO: 4785 - protein, 400 aa, Staphylococcus epidermidis
IMKHILLAVTGGIAAYKAIDLTSKLIQSGYDVRVMLSDHAQEFVTPLAFQAISRNPVYTNTFKEENPEEIQHVSLGDWADAIIVAPATANTIAKLSVGIADDLITSTLLATTTPKFVAPAMNVNMYNNPRTKHNMKVLSQDGYYFIEPGSGYLACGYVAKGRMEEPMQILSVINKFFTQQKNVVKSSFSGKRALVTAGPTVEVIDPVRYVSNRSSGKMGYAIAEALRDKGAIVTLISGPTHLSLPEGINVVKVESADDMFQAVTERFAKQDIVIKAAAVSDYTPMDILEHKLKKQEGGLSVQFKRTKDILKYLGENKTHQYLVGFAAETQNIEQYALDKLKRKNADVIISNNVGDTSIGFSSDDNELTMHFKNNEKVNIKKGKKSALAHQIIEILETRWQ

SEQ ID NO: 4786 - protein, 67 aa, Staphylococcus epidermidis
MEVNKVIYILLAVFLGSFGIHKFYAGKPIQGLLHILFCWTAIPHVLAIISAVLTLFKPADANGNVRM

SEQ ID NO: 4787 - protein, 246 aa, Staphylococcus epidermidis
VVANQKKKEMVHDFQQKFTDKMKSLGLHFKNIDLYQQAFSHSSFINDFNMNRLEHNERLEFLGDAVLELTVSRYLFDRHPHLPEGNLTKMRATIVCEPSLVIFANKIKLNELILLGKGEEKTGGRTRPSLISDAFEAFVGALYLDQGLDSVWTFAEKVIFPYVEDDELVGVVDFKTQFQEYVHSQNKGDVTYQLIKEEGPAHHRLFTSEVILENKAVAEGKGKTKKESEQKAAEQAYKLMKNKKSL

SEQ ID NO: 4788 - protein, 269 aa, Staphylococcus epidermidis
KENKMFHNKNANFVNGVTINIKDKETIKTFYENVLGFNLINESETAVQFEVGDSNQFITFIEIQNGREPLMSEAGLFHIGILLPTLTTLADLLVHLSDFEVPVNGGQQSVATCLFIEDPEGNAIKFYVDRETESWIDEKEGRIRMDIAPINVPRLLQNVSHTQWQGIPDETKLGSLHIKSIRISDVKSYYLNYFGLEESAYMDDYSLFLSSNEYYNHLAVNQWLSATKRVDNEHTYGLAMIDFHYPKTTHKNLKGPDGIYFRFNRIKEV

SEQ ID NO: 4789 - protein, 215 aa, Staphylococcus epidermidis
RNDNVKINLLCSQRLLPNHIFEKEKDSNWAGIDRGALILVKQGIQPIFSVGDFDSVNNEERLMLMKNLQIEPVEAEKDDTDLALGVAQAVERGYTEITIYGATGGRLDHFMGVLQILQKPQYLHQSIKIKVIDQQNHIQLLNEGKYVINRDSTYPYISFIPLNDKTILTLQGFKYNLNQEHLNLGSTLTISNEVKVNEAIIRVEQGTVLKIRSRD

SEQ ID NO: 4790 - protein, 210 aa, Staphylococcus epidermidis
VIDKESVMIFKEYLRLGTKMRGERLKLKKNDRRVAIKEAIELNPFITDYELCEKFDVSIQTIRLDRTHLNIPELRKRIKLVAEQNYGRIKSIEANEIIGDLIQVNPDVSAQSLIEITIDSVFAKSEIARGHVLFAQANSLCVALIHKPIVLTHESQVEFKEKVKLNDTVRADARVIDITDKHYIIEVNSYVSDMLVFKGKFKMYYTSEDE

SEQ ID NO: 4791 - protein, 208 aa, Staphylococcus epidermidis
GMDKEKGLLIVLSGPSGVGKGTVRKKIFEDPTTSYKYSISMTTRHMREGEIDGVDYFFKTKEEFEALIKDDQFIEYAQYVGNYYGTPVQYVKDTMEEGHDVFLEIEVEGAKQVRKKFPDALFIFLAPPSLDDLKERLVGRGTESDEKIQSRVNEARKEVEMMNLYDYVVVNDEVELAKNRIQSIVEAEHLKRERIEAKYRKMLLEVKK

SEQ ID NO: 4792 - protein, 63 aa, Staphylococcus epidermidis
HEFKMEKCKLFFFFFIQGKDIERDGFQIRRTTVENGVPCLTSLDTASALTNVIESMTFTMRNV

SEQ ID NO: 4793 - protein, 81 aa, Staphylococcus epidermidis
LLLNVTFKLDKEFLSDFKLVLYAIQLFYNLLVIKKPRTIFMSQALPILIKLYPKYSFGTTGSILPSAISSKAFPTGLAEWY

SEQ ID NO: 4794 - protein, 1037 aa, Staphylococcus epidermidis
RISKKRSVKSMPKRDDIKTILVVGSGPIIIGQAAEFDYAGTQACLALKEEGYRVILVNSNPATIMTDKEIADKVYIEPLTHDFIARIIRKEQPDALLPTLGGQTGLNMAIQLHDSGVLEANNVKLLGTELESIQQAEDREMFRTLMNDLNVPVPESDIVNTVEQAFEFKEQVGYPLIVRPAFTMGGTGGGICHNDAELKEVVSNGLHYSPATQCLIEKSIAGYKEIEYEVMRDKNDNAIVVCNMENIDPVGIHTGDSIVVAPSQTLSDVEYQMLRDVSLKVIRALGIEGGCNVQLALDPHSLNYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESYELDYIKERIGHQDDERLFFIGEAIRRGTSLEELHNMTKIDYFFLNKFQNIIDIEHELKNHQGDLEYLKYAKDYGFSDKVIAHRWDKEEKDIYQLRMSQNIKPVYKMVDTCAAEFESTTPYYYGTYEYENESIVTDKEKILVLGSGPIRIGQGVEFDYATVHAVWAIQNADYEAIIVNNNPETVSTDFSISDKLYFEPLTEEDVMNIINLEQPKGVVVQFGGQTAINLADKLAQHGVKILGTSLEDLNRAEDRKEFEALLREIAVPQPQGKTATSPKEALENAREIGYPVVVRPSYVLGGRAMEIVDNDQELENYMTQAVKASPEHPVLVDRYLTGKEIEVDAISDGETVVIPGIMEHIERAGVHSGDSIAVYPPQTLTQDEINTLEDYTIKLAKGLNIKGLINIQFVIAHDGVYVLEVNPRSSRTVPFLSKITDIQMAQLAMRAIMGETLAEIGFKQGIQPYSEGVYVKAPVFSFNKLKNVDITLGPEMKSTGEVMGKDLTLEKALYKGLTGSGFEVKDHGTVLMTVSDKDKDEIVKIAHRLNEIGYKILATRGTAQKLKDHNIPVEVVGKIGGEDDLLTRIQNGEVQIVFFFFYSRKRYRTRWIPNSTYNS

SEQ ID NO: 4795 - protein, 338 aa, Staphylococcus epidermidis
RRANVMAFEGLSDRLQATMQKMRGKGKVTEADIKTMMREVRLALLEADVNFKVVKEFVKNVSERALGSDVMQSLTPGQQVIKIVQEELTSLMGGENTSIKMANKPPTVVMMVGLQGAGKTTTAGKLALLMRKKYNKKPLLVAGDIYRPAAIDQLQTVGKQIDIPVYSEGDQVSPQQIVENALKHAKEEHLDFVIIDTAGRLHIDEALMNELQEVKEISKPDEIMLVVDAMTGQDAVNVAQSFDEQLDVSGVTLTKLDGDTRGGAALSIRSVTQKPIKFVGMSEKLDGLELFHPERMASRILGMGDVLSLIEKAQQDVDQEKAKDLEKKMRESSSSLNL

SEQ ID NO: 4796 - protein, 138 aa, Staphylococcus epidermidis
RFKNKTLKFSGGTDMTLEISNDYGKIDISNDVIASVVGGKAVESYGIVGMASRQQVRDGIAEILGHDNYAKGIKVREDNGIIDVDMYIIVSYGVKISEVASNLQSTVKYTLEKTLNVKVNSINIFVQGVRVNETVKKV

SEQ ID NO: 4797 - protein, 203 aa, Staphylococcus epidermidis
MAKNIAKALLDIEAVSLSPNDLFTWSSGIKSPIYCDNRITLGYPEVRNAIRDGLIQLIKEHFSNVEIISGTATAGIPHAAYISEKLELPMNYVRSKSKSHGKQNQIEGAKSENKNVVVVEDLISTGGSSITAVEALEEAGANVLGVVAIFTYGLAKADKTFNKAHIPFYTLSDYNELIEVAKDEGKISLNDIQTLVDWRDNLS

SEQ ID NO: 4798 - protein, 373 aa, Staphylococcus epidermidis
QDKKKGKLEMITAEKKKRNKFLPNFEKQSIYSLRYDEMQQWLIDHGQQKFRAKQIFEWLYQKRVNTIDEMTNLSKELRQILKDHFAMTTLTTVVKQESKDGTIKFLFELQDGYTIETVLMRHEYGNSVCVTTQVGCRIGCTFCASTLGGLKRNLEAGEIVSQVLTVQKALDETNERVSQIVIMGIGEPFENYDEMMDFLRIVNDDNSLNIGARHITVSTSGIIPRIYDFAEEDIQINFAVSLHGAKDEIRSRLMPINRAYNVDKLMEAIRYYQEKTNRRVTFEYGLFGGVNDQLEHARDLAHLIKNLNCHVNLIPVNHVPERNYVKTPKDDIFKFEKELKRLGINATIRREQGSDIDAACGQLRAKERQVETR

SEQ ID NO: 4799 - protein, 366 aa, Staphylococcus epidermidis
MLEKRYLVLEDGSYYEGYRLGSDDLSIGEIVFNTAMTGYQETISDPSYTGQIITFTYPLIGNYGINRDDFESLTPKLNGVVVKEASTHPSNFRHQKTLHETLAQYHIPGISGVDTRSITRKIRNYGVLRAGFTDNKDNIQELVEQLKTAELPRDEVQTVSTKTPYVSTGSDLSVVLLDFGKKQNIVRELNLRGCNVTVVPYDTSAEEILGMSPDGVMLSNGPGDPDEVDVALDMIRGILGKIPFFGICLGHQLFALSQGATSFKMKFGHRGANHPVKDLRTGKIDITSQNHGYSIDCDSLKNTDLEVTHIALNDGTVEGLRHKELPAFSVQYHPEARPGPSDSNYLFDEFIAMMKDFKEKERQINA

SEQ ID NO: 4800 - protein, 563 aa, Staphylococcus epidermidis
DSEKGLGGQREMISKINGKLFADMIIQGAQNLSNNADLVDSLNVYPVPDGDTGTNMNLTITSGREEVENNLSQNIGELGKTFSKGLLMGARGNSGVILSQLFRGFCKNIEEEKEISVQQFAESFQAGVETAYKAVMKPVEGTILTVAKDAAKAAMDYVDQAEDCVDLMAHLIEAASESLDNTPNLLAVLKEVGVVDSGGKGLLCVYEGFLKGLKGEKIEAQAPKLDTESFVNDDHDFHGVINTEDIVYGYCTEMMVRFGKNKKAFDEQEFRNDMSEFGDSLLVINDDEIVKVHVHTEHPGDVFNYGQKYGELIKLKVENMREQHREVIRKEQDGLQSKEANESKTVETAIVTISVGDGIAELFKSMGATHIISGGQTMNPSTEDIVKVIEQSQCKRAIILPNNKNIMMASEQAASIVEAETVVIPTKSIPQGISALFQYDLESSLEDNKRHMSDALETVQSGSITFAVRDTKIDGIEIKKDEFMGLAEDKIVTSDVNQFHAVKGLLSKLLNEDSEILTMISGEDADNSITNQIINWIESEYPDVEVEQHEGGQPIYQYFFAVE

SEQ ID NO: 4801 - protein, 265 aa, Staphylococcus epidermidis
NILKERFIKKNHYLDYEFDEGSDIKLGFTTRENGLSPYPNHSFNMARYISDSAHHITHHQNILANLIGYTRDEWVFPIQTHDNRIVEVTSEHKGTNIDELTDDLHGIDGMYTFDSHILLTMCYADCVPVYFYSEPHGYIGLAHAGWRGTYGQIVKEMLKKVDFDYEDLKIVIGPATSNSYEINDDIKNKFEELTIDSTLYIETRGKNQHGIDLKKANALLLEEAGVPSKNIYVTEYATSENLDLFFSYRVEKGQTGRMLAFIGRK

SEQ ID NO: 4802 - protein, 320 aa, Staphylococcus epidermidis
MKLKWRRILTMSKIIFMGTPDFSTKILEMLIAEHEVIAVVTQPDRPVGRKKVMTPPPVKRVATKHQIPVYQPEKLKDSQELESLLSLESDLIVTAAFGQLLPESLLNAPKLGAINVHASLLPKYRGGAPIHQAIIDGEEETGITIMYMVKKLDAGNIISQQSIRIEEEDNVGTMHDKLSFLGAELLKKTLPSIIDNTNDSIPQDDALATFASNIRREDERVDWNMSAQAIHNHIRGLSPWPVAYTTMNEKNLKLFSAFIVKGKKGNPGTIIETTKHELIIATGSDDAIALTEIQPAGKKRMKVTDYLSGVQESLVGKVLL

SEQ ID NO: 4803 - protein, 427 aa, Staphylococcus epidermidis
FYMKLIKNGKILKNGILKDTEILIDGKRIKQISSKINASSSNIEVIDAKGNLIAPGFVDVHVHLREPGGEHKETIESGTKAAARGGFTTVCPMPNTRPVPDTVEHVRELRQRISETAQVRVLPYAAITKRQAGTELVDFEKLALEGVFAFTDDGVGVQTASMMYAAMKQAAKVKKPIVAHCEDNSLIYGGAMHKGKRSEELGIPGIPNIAESVQIARDVLLAEATGCHYHVCHVSTKESVRVIRDAKKAGIHVTAEVTPHHLLLTENDVPGDDSNYKMNPPLRSNEDREALLEGLLDGTIDCIATDHAPHAKEEKAQPMTKAPFGIVGSETAFPLLYTHFVRRGNWSLQQLVDYFTIKPATIFNLNYGKLHKDSYADLTIIDLNTEKEIKSEDFLSKADNTPFIGEKVYGNPTLTMLKGEVVFEEEK

SEQ ID NO: 4804 - protein, 133 aa, Staphylococcus epidermidis
NKMKIFLKKSLEIHPLNLKKVTKMGQNDLVKTLRMNYLFDFYQSLLTNKQKNYLELFYLQDYSLSEIADTFEVSRQAVYDNIRRTGDLVEDYESKLRLYQRFEKRRELYNLMKQSLNQPELLKQYITQLEELE

SEQ ID NO: 4805 - protein, 161 aa, Staphylococcus epidermidis
KKCDDMKKAIIVMFVVTVILTIAALIDEFMIQDAKHGQSRFTSHHPMKINTYKKGQCTYYVFERVKNDGNKINNTWSDAKHWDKKAIDDGYIVDRNPKKGSILQSSKGKYGHVAYIETINEDGSMQVSEMNYTQPYEITKRTIHTYDIKNYYYIHPQKIKT

SEQ ID NO: 4806 - protein, 258 aa, Staphylococcus epidermidis
ITIDIYQHFRKEEQDALDQFIDKCKQADANYAPVLTHFLDPRGQYILEVITRSYQDLHVTFFGGPHAERKRAIIAPLYFKPQPEDFELTLFELQYPKKFVTIQHQHVLGTLMSLGIQRDQLGDIIVGEDIQFVLTKQLESYIISELTRIKGASVKLNSIPTEDMIQSEENWKVHSTTVSALRLDVVLKEMIHKSRNIAQQLIIKKRVKVNHTVIDSTDFQLEQNDLLSIQGYGRAQIVEIGGKTKKNKLHIHYQTLFK

SEQ ID NO: 4807 - protein, 111 aa, Staphylococcus epidermidis
SHREYGATLRIRSSTMDIGLLSTIFRFIIFLVQIYYFGMIIYFFTSWVPSIRESKFGEFLGKLYEPFLEPFRKIIPPIGFIDISSIAAIFVLVLFQSGLVKIFNLILAYLS

SEQ ID NO: 4808 - protein, 437 aa, Staphylococcus epidermidis
INMENEQMFERTVQPVLDVKDKPKPAQWAFLSLQHLFAMFGSTVLVPFLTHLPISAALLASGIGTLLYILITKAKIPAYLGSSFAFITPIITGLSTHSLGDMLVALFMSGLMYVIIGIFIKLSGTHWLMHLLPPVVVGPVIMVIGLSLAPTAVNMAMFENSAEMKGYNLSYLIVALITLAVTIIVQGFFKGFLSLIPVLIGIIVGYIVSIFMGIVKFAPIAQAKWIDFPHIYLPFKDYTPSFHLGLILVMIPVVFVTVSEHIGHQMVINKIVGRNFFENPGLDKSIIGDGVSTMFASMIGGPPSTTYGENIGVLAITKIYSIYVIGGAAVIAIILAFIGKFTALISSIPTPVMGGVSILLFGIIAASGLRMLVESQVDFASNRNLVIASVVLVVGIGNLLINLKGIGINLQIEGMALSALSGIILNLILPKDKNQIN

SEQ ID NO: 4809 - protein, 79 aa, Staphylococcus epidermidis
SDVENFDKVKDIIVDRLGVDADKVTEDASFKDDLGADSLDIAELVMELEDEFGTEIPDEEAEKINTVGDAVKYINSLEK

SEQ ID NO: 4810 - protein, 68 aa, Staphylococcus epidermidis
RQLWLSKSISLVKRERNRIHNEFIIPPSRNMTLNRESNKIFITETQTLKRFILSTFQGSQSTAKRFNG

SEQ ID NO: 4811 - protein, 450 aa, Staphylococcus epidermidis
LFKWCTRVVSWESSIMMKSVRTYALETINDVLNKGAYSNLKINEVLSTNNINTVDKNLFTELVYGTIKRKYTLDYLLKPFIKTKIKSWVRQLLWMSLYQYLYLDKIPNHAIIHEAVDIAKKRGGFHTGNIVNGILRTVMRTELPSFEDIDDTKKRIAIQYSLPKWIVDHWVTHFGVEKTENIARSFLEPVTTTVRANISRDSIDSIISKLEQEGYHVKKDDMLPFCLHISGMPVVNSNAFKEGYISIQDKSSMMVAYVMNLGRDDKVLDACSAPGGKACHMAEILSPEGHVDATDIHEHKINLIKQNIKKLKLNNIKAFQHDATEVYDKMYDKILVDAPCSGLGVLRHKPEIKYSQSQNSIKSLVELQLQILENVKDNIKPGGTIVYSTCTIEQMENENVIYTFLKRHKDFEFEPFQNPATGEQVKTLQILPQDFNSDGFFISKIKRKES

SEQ ID NO: 4812 - protein, 77 aa, Staphylococcus epidermidis
VDKLGAILTIIKNYQYRLKLYMIINHRLSYFYNYNDFLFFISLYACSAAFCSDSFFVFPLPSATALFSKITSDVNSL

SEQ ID NO: 4813 - protein, 573 aa, Staphylococcus epidermidis
KSIRWQIIMAYDGLFTKKMIESLQGLVSGRIHKINQPENDTIIIVIRQNRKNHQLLLSIHPSFSRLQLTTKKYDNPFTPPMFARVFRKHLEGGFIKAIRQVGNDRRIEIDIESKDEIGDTIYRTIILEIMGKHSNLILVDDQRKIIEGFKHLTPNTNQYRTVMPGFKYEAPPNQNKINPYELTGQEVLKYIDFNAGKIAKQLLNICEGFSPLIANEIVNRRQFMTQETLPDAFDEVMAETKSAPTPVFHKNHETGKEDFYFMKLNQFYDDIVEYHSLHELLDRFYDARGERERVKQRANDLVRFVQQQLQKQQNKLSKLIDEYESAKNKETQQLYGELITANIYRIQQGDDSVIALNYYTGEEVKIPLNPTKSPSTNAQYYYKQYNRMKTREHELTHQIKLTKENIDYFDNIEQQLKHITVDDIDDIRDELAEQGFMKQRKQSKKKKQSKIQLQTYHSTDGDTILVGKNNKQNDYLTNKKARKNHLWFHTKDIPGSHVVILNESPSETTIKEAAMLAGYFSKAGSSAQIPVDYTEIRHVHKPSGAKPGFVTYDNQKTLFATPDYDHIQQMKES

SEQ ID NO: 4814 - protein, 204 aa, Staphylococcus epidermidis
ENRSEPPLALKDLFNNFFVVEEEEEVEGPEERESSRSRERVQEREDYNRNENQATPQTFNNKQQAIKSVPQKNTLRSNTTSEERNYRMNNNSKNNSRNVVTMNQASQSYAAQESSKMCLFEPRVFSDTQDIADELKNRRATLVNLQRIDQVSAKRIIDFLSGTVYAIGGDIQRVGTDIFLCTPDNVEVAGSITDHIENMEQHYE

SEQ ID NO: 4815 - protein, 74 aa, Staphylococcus epidermidis
MVRRRLMEQNNDNNHLYTLIKHCNEFLYRRDDYRIPSDSQSDHSNNENILKTMNDEVFKHSIEIFKRAKKNLNH

SEQ ID NO: 4816 - protein, 668 aa, Staphylococcus epidermidis
SMIGKVINERYTITDKLGGGGMSIVYLAVDSILNRKVAIKAISIPPSEKEETFKRFEREVHNSSQLSHENIVSMIDVDEEDDCFYIVMEYIEGPTLAEYIHSHGPLSVETAIQFTEQILSGIKHAHDMRIVHRDIKPQNILIDKNKKLQIFDFGIAKALSETSLTQTNHVLGTVQYLSPEQAKGEATDESTDIYSIGIVLYEMLVGEPPFNGETAVSIAIKHIQDSIPNITTDKRDDVPQSLSNVVLRATEKDKYHRYHTVQEMCDDLTSALHENRLNEEKYELDKTKTVPLTKDDLNHKIYDEQNQNDLNKTMQIPIVNDSIKQQEFQSSEPRYYQKSDKKRSKMKIAILSIIFVILLIGLFSFVAMAVFGNKYEEMPDLKGKTEKQAEKVLDSHHLKVGDISRNYSDKYPENQIIKTNPDSGERVEQGNRVDIVLSKGPEKVKMPNVLGMSKNDALKKLKAIGFKDIHVEQAYSQTYEKGLISEQSVVANSEVAVNNHHITIYESLGVRQVYVNNYENKSYESAKKELEDKGFKVQVTKENNDDVEKGNVISQSPKDKTVDEGSTILLVVSKGEKSEEDDDEEDKDTTTKNETVKVPYTGKKSKSQKVEVFIRDIENKGDSAVQTFNIKSDKTINIPLKIKKGSDAGYTIRVDNKIVADKDVSYDG

SEQ ID NO: 4817 - protein, 415 aa, Staphylococcus epidermidis
GYEGGTSMSFFKRLKDKFSSKSEDDIQKDLDETVDSNANSDSDSMDPNDSDEQVKPKKKPKKLSEADFDEDGLISIEDFEEIEAQKIGAKFKAGLEKSRQNFQEQLNNLIARYRKVDEDFFEALEEMLITADVGFNTVMKLTDELRTEAQRRNIQETEDLREVIVEKIVEIYHQEDDYSEAMNIEDGRLNVILMVGVNGVGKTTTIGKLAYRYQQEGKKVMLAAGDTFRAGAIQQLNVWGERVGVEVVSQNEGSDPAAVVYDAINAAKNKGVDILICDTAGRLQNKSNLMQELDKMKRVINRAIPDAPHEALLCLDATTGQNALSQARSFKEVTNVSGIVLTKLDGTAKGGIVLAIRNELHIPVKYVGLGEKMDDLQPFNPESYVYGLFADMIEQNEDIPEEISRNSSVESEEGN

SEQ ID NO: 4818 - protein, 73 aa, Staphylococcus epidermidis
CVFIFIKGGTFMGKQCFVTGRKASTGNHRSHALNANKRRWNANLQKVRILVDGKPKKVWVSARALKSGKVTRV

SEQ ID NO: 4819 - protein, 136 aa, Staphylococcus epidermidis
HMDIPKITTFLMFNDEAEEAIQLYTSLFEDSEIITMVKYGEEGPGTPGSVQHSIFTLNGQVFMAIDANSGEELPMNPAMSLYVTVKDTMEMERLFNGLKNEGAILMPKTEMPPFREFAWVQDKFGVSFQLALPENK

SEQ ID NO: 4820 - protein, 1211 aa, Staphylococcus epidermidis
FLIIVNIAPSLSTQHDCDKENTMVYLKSIDAIGFKSFADHTNVQFDKGVTAIVGPNGSGKSNITDAIKWVLGEQSAKSLRGAKMEDIIFSGAEHRKAQNFAEVKLKLDNHSQKLQIDSEELVVTRRLYRSGESEYYLNNDRARLKDIIDLFLDSGLGKEAFSIISQGRVDEILNAKPINRRQIIEESAGVLKYKKRKAESIQKLDHTEDNLNRVEDILYDLEGRVEPLKEEAAIAKEYKQLSKEMEQSDVIVTVSDIDHYTEDNQRLDERLNHLKSQQAEKEGQQAQINQLLQKYKGKRQQNDYDIEKLNYELVKATENYEQLSGKLNVLEERKKNQSETNARYEEELDNLESQIDSIKNEKAQNEKLLADLKNKQKQLNKEVQELESLLYISDEQHDEKLEEIKNSYYTLMSEQSVVNNDIRFLEHTINENEAKKSRLDSRLVEAFNQLKDIQQNITQTQKEYQSSKKSMEKVEQNIQQLEQQLTDSKRLLSEYENKLYQAYRYNEKLKSRIDSLATQEEDYTYFFNGVKHILKAKDKELRGIHGAVAEVINVPSEMTQAIETALGASLQHVIVDNEKDGRQAIQYLKQRGLGRATFLPLNVIQPRHVAADIKDVARGSQGFINIASDAINVSAKYQNIIENLLGNTIIVENLKHANELARAIRYRTRIVTLEGDVVNPGGSMTGGGARKTKSILSQKDELSTMRNQLEDYQRQTAEFERQFKEQKTQAEQLSEQYFSASQQYNNLKEQVHHHELELDRLKTQEAHLKNEHEEFEFEKNDGYQSDKSKETLKEKQNHLIEIQQQLKQLESDIERYTQLSKEGKASTHQTQQQLHQKQSDLAVVKERIKSQKQVYERLDKQLSDSERQKIEVNEKIKLFNSDEMMGKDAFEKLKEQIQQQENVRQNLNQQLSEIKQQRKDLNEKIEINESQLQKCHQDILSIENHYQDIKAKQSKLDVLINHAIDHLNDTYQLTVERARMEYDSDETIDNLRKKVKLTKMSIDELGPVNLNAIEQFEELNERYTFLNEQRTDLREAKETLEQIIHEMDKEVEGRFKTTFHAVQDHFTTVFKQLFGGGQAELRLTEDDYLSAGVDIIVQPPGKKLQHLSLLSGGERALSAIALLFAILKVRSAPFVILDEVEAALDEANVIRYAQYLNELSTETQFIVITHRKGTMEFSDRLYGVTMQESGVSKLVSVNLNTIDEVMKEEQA

SEQ ID NO: 4821 - protein, 805 aa, Staphylococcus epidermidis
VAVMIAKVIVDIPSKSVDFKFDYIVPKNLERVIQIGVRVVVPFGPRTIQGYVMNIQQEPDGNMDISKLKEIKEVRDIKPELTSELIQLSEWMSHYHVMKRISVLEAMLPSAIKAKYKKAFSIIDPKNLSSKTKALFNNDGYYLYKEAQQNNDLEEMLTLLNQGLIEEVTILSQNTKKKTQKAVGVVNTLNGDEVLAKLEKYTKQYDLYAFLLEESHRTVFLKEINDMGFSHSSLDSLIKKGYIEKYTAEVFRDPYANRIFEQEQKRILTKEQQDAFEAIQHYIHDEKERTFLLHGVTGSGKTEVYLQTIEEVLNKGKEAMMLVPEIALTPQMVLRFKRRFGDDVAVLHSGLSKGERYDEWQKIRDGRARVSVGARSSIFAPFKNLGIIIIDEEHESTYKQEDYPRYHARDIAQWRSQFHHCPVVLGSATPSLESYARAEKNVYELLSLPHRVNQQALPHIDIIDMREELSEGNRSMFSIALRQAIQERLDKKEQIVLFLNRRGYASFMLCRDCGYVPQCPHCDISLTYHKTTDQLKCHYCGYQENPPSQCPNCEGDHIRQVGTGTQRVEELLQQEFPHARIIRMDVDTTSRKGAHEKLLNDFEAGKGDILLGTQMIAKGLDYPNITLVGVLNADTMLNLPDFRASERTYQLLTQVSGRAGRHEKEGQVIIQTYNPDHYSIKDVKLNDYLSFYQKEMNYRKLGKYPPYYFLINFTISHTDIKKVMMASKHIHQILVQHLSEKAFVLGPSPAALARINNEYRFQILVKYKSEPQLHPALQYLDDYYHDQYVKDKLSLKIDINPQMMM

SEQ ID NO: 4822 - protein, 74 aa, Staphylococcus epidermidis
SFKIISIIIIIEKLHYKFIINLSLVVTHLAIIAHIFISYNFIINSYGVPSVTSFFNFQRNINCFITFNIKRLNC

SEQ ID NO: 4823 - protein, 214 aa, Staphylococcus epidermidis
MVKILPSLLSIDFLNLKEELQLLETAKVDGLHFDVMDGKFVPNISIGIPILDAVRQQSHLPIDVHLMIEQPENYINLFAEHGADMISVHVESTTHIHRAIEQIKQLGKKAGVVINPGTSVETILPILSIVDYVLVMTVNPGFGGQTFIEQCVTKIEQLNQLKHENHLTFDIEVDGGINDQTSKRCVEQGATMLVTGSYFFKQEDYAKVTSLLKE

SEQ ID NO: 4824 - protein, 311 aa, Staphylococcus epidermidis
VSKMGKIAVVFPGQGAQKVGMASDLYNEEERSTRVLNLAQETVDFDLLETMFTDNDGKLGETENTQPALLTHSVALLESLNHLKVDYTMGHSLGEYSSLVSSDVLSFEDAVRIVRKRGQLMAQAFPNGVGGMAAVLGLDYDDVDKICQTLSTKEQLIEPANINSPGQIVVSGHKSLIDELVEKGKELGAKRVLPLAVSGPFHSSMMKVIEEDFANFINQFEWHNANYPVVQNVNAKGETDAEVIKRNMVKQLYSPVQFIQSTEWLINQGVDHFIEIGPGKVLSGLIKKINRDVKITSIQTLEDVKGWNNHE

SEQ ID NO: 4825 - protein, 249 aa, Staphylococcus epidermidis
KDGIIMNKSALVTGASRGIGRSIALQLAEEGYNVAVNYAGSKDKAEAVVEEIKAKGVESFAIQANVAKGDEVKEMIKEVVSQFGSVDVLVNNAGITKDNLLMRMKEQEWDDVIDTNLKGVFNCIQKVTPQMLRQRSGAIINLTSIVGAMGNPGQANYVATKAGVIGLTKTAARELASRGITVNAVAPGFIVSDMTNALSDDLKDQMLEQIPLKRFGEDTDIANTVAFLASDKAKYITGQTIHVNGGMYM

SEQ ID NO: 4826 - protein, 76 aa, Staphylococcus epidermidis
NGLIENQMEFYNHLVYKETHYNVLLKCKDDYYHYFVPLDASSPFIYYDKLSRQSTNVWISFKEILPSSFATSISSL

SEQ ID NO: 4827 - protein, 235 aa, Staphylococcus epidermidis
KEKMSVRNLPIIALDFKSADEVHTFLNKFNEPLCVKIGMELFYQTGPALIKSIKKRGHDIFLDLKLHDIPNTVSKAMEGLARLDVDLVNVHAAGGIKMMEEAKKGLRKHNADIKIIAVTQLTSTTERQLHEEQNIQTSIEEAVLNYARLTKKAGLDGVVCSPLEAEMISKELGTDFLKVTPGIRPKGAARNDQQRITTPEEAKTLGSTHIVVGRPITQSEHPIDSYHKIKESWLS

SEQ ID NO: 4828 - protein, 163 aa, Staphylococcus epidermidis
VMTVKKLVKSTHPILNKTIQPVSTYDQKLKVLLEDLEDTLYHEEAAAISAPQIGVDQSVALIDMEQEGLLQLINPVVKSQSQETVSDLEGSISLPHIYGEVKRSKMITVQSYDINGNAVELTAYDDIARMILHMIDHLNGIQFTKRAHHILNETEVEAYFDNE

SEQ ID NO: 4829 - protein, 223 aa, Staphylococcus epidermidis
FMDVKENLAKIEKEIDASIKKSAHSAQPHVIAVTKYVTIERAREAYKVGIRHFGENRLDGFKEKKESLPSDVKLHFIGSLQSRKVKDIINEVDYFHALDRLSLAKEINKRANHVIKCFLQVNVSGEESKHGIALEEVNQFINQIKEYENIQIIGLMTMAPLTDDLSYIRNLFKELRHKRNEIQQFNLAHAPCTELSMGMSNDYQMAVEEGATFVRIGTKLVGE

SEQ ID NO: 4830 - protein, 296 aa, Staphylococcus epidermidis
MRGVFLKTGRIVKLISGVYQVDVEGERFDTKPRGLFRKKKFSPVVGDIVDFEVQNTKEGYIHHVHDRNNELKRPPVSNIDELVIVMSAVEPEISTQLLDRYLVIAHSYHLKPRILITKHDLASEQEILKIKDTIKIYQKIGYATQFIGKDSNYTATVDEWSDGLIVLSGQSGVGKSTFLNSYQPQLKLETNDISKSLNRGKHTTRHVELYDRKGGYIADTPGFSALDFNHIEKEQLKDFFIDIHEAGEQCKFRNCNHIKEPQCHVKALVEKGEIPQFRYDHYQQLYNEISNRKVRY

SEQ ID NO: 4831 - protein, 927 aa, Staphylococcus epidermidis
SSFLSLQGVNLMNYKDTLLMPKTDFPMRGGLPNKEPQIQEMWDNDEQYRKALEKNKNNPSFILHDGPPYANGNLHMGHALNKIIKDFIVRYKTMQGFYAPYVPGWDTHGLPIEQALTKKGVDRKKMSVAEFREKCKEFALKQIDIQKKDFKRLGVRGDFNNPYITLTPEYEAAQIRLFGEMADKGLIYKGKKPVYWSPSSESSLAEAEIEYHDKRSASIYVAFDVKDSKGKVDSDAQFIIWTTTPWTIPSNVAITVHPELKYGQYNVDGHKYIVAQALSEEVAEALGWDKDSIQLEKEFTGKELEFIEAQHPFLDRVSLVINGEHVTTDAGTGCVHTAPGHGEDDYIVGQKYDLPVISPLNDKGVFTEEGGPFEGMFYDKANKAVTDLLKEKDALLKLDFITHSYPHDWRTKKPVIFRATPQWFASINKVRQDILDAIEDTNFKVDWGKTRIYNMIRDRGEWVISRQRVWGVPLPVFYAENGDIIMTKETVNHVADLFEKYGSNIWFEKEAKELLPEGFSHPGSPNGEFTKETDIMDVWFDSGSSHRGVLETRPELSFPADLYFEGSDQYRGWFNSSITTAVATRGQAPYKFLLSHGFFMDGEGKKMSKSLGNVIVPDQVVKQKGADIARLWVSSTDYLSDVRISDEILKQTSDVYRKIRNTLRFMLGNINDFNPETDSIAETNLLEVDRYLLNRLREFTASTINNYENFDYLNIYQEVQNFINVELSNFYLDYGKDILYIEKKDSHKRRSMQTVLYQILIDMTKLLAPILVHTAEEVWSHTPHVKEESVHLSDMPKVVDVDEELLEKWNTFMNLRDDVNRALEQARNEKVIGKSLEAKVVIGNNETFNTAEFLQQFNDLQQLFIVSQVEVKDKVNDGVSYQYGDIHIKHAEGEKCERCWNYTEELGSVGELEHLCPRCQEVVKTLV

SEQ ID NO: 4832 - protein, 341 aa, Staphylococcus epidermidis
FLKVNSKCTIQVRMNEMVKIAVDMMGGDDAPGIVLDAVKKAVEDFKDLEIILFGDESQYNLSHERIEFRHCTEKIEMEDEPVRAIKRKKDSSMVKMAEAVKSGEADGCVSAGNTGALMSAGLFIVGRIKGVARPALVVTLPTTDGKGFVFLDVGANADAKAEHLLQYAQLGNIYAQKIRGIQNPSVSLLNIGTEAAKGNSLTKKAYDLFEKNQSFNFTGNIEAKTLMDGNVDVVVTDGYTGNMVLKNLEGTAKSIGKMLKETIMSSFKNKLAGAVLKKDLETFAKKMDYSEYGGSVLLGLDGTVVKAHGSSNAKAFYSAIRQAKIAGEENIVQIMKDTVGE

SEQ ID NO: 4833 - protein, 131 aa, Staphylococcus epidermidis
RNTLSASLNASIIGVDLSTISNKRSFGITINVSTAAFIDSTPAAACVWRLRPSKPNGRVTTPTVKAPISFAILATTGAAPVPVPPPIPAVTNTISAPWIASSICSLDSSAAFFPISGLAPAPNPRVNFSPI

SEQ ID NO: 4834 - protein, 394 aa, Staphylococcus epidermidis
MLEFEQGFNHLATLKVIGVRGGGNNAVNRMIDHGMNNVEFIAINTDGQALNLSKAESKIQIGEKLTRGLGAGANPEIGKKAAEESREQIEDAIQGADMVFVTAGMGGGTGTGAAPVVAKIAKEMGALTVGVVTRPFGFEGRKRQTQAAAGVESMKAAVDTLIVIPNDRLLDIVDKSTPMMEAFKEADNVLRQGVQGISDLIAVSGEVNLDFADVKTIMSNQGSALMGIGVSSGENRAVEAAKKAISSPLLETSIVGAQGVLMNITGGESLSLFEAQEAADIVQDAADEDVNMIFGTVINPELQDEIVVTVIATGFEDKPSSQGRKATSTGFGSSVNSSSNHQSGASAKEDSFSAHTSHSQSSESVNERSHTTKDDDIPSFIRNREERRSRRTRR

SEQ ID NO: 4835 - protein, 75 aa, Staphylococcus epidermidis
CNNSMNVGQARVAHYIHLQYLKHELLLKIRLVAFDILHLTVFDSVQQRLNLQYECLQDLCSPYYILRLRYHFYHA

SEQ ID NO: 4836 - protein, 227 aa, Staphylococcus epidermidis
MSQSSKRKNDSVVETFKDIIPLTFGEEIGNAASHGAAALLTLFILPYAAVHSFNNGGTLESISVSVYVISIFMMFISSTIYHSMQNNTSHKYILRIIDHSMIYVAISGTYTPVLLSVVGGWLGWLVTILLWGTTLWGILYKSIATKVNHRLSLIVYLVMGWVGIIFLPIIIMRTSWWFIFFIFLGGLSYTIGAWFYAQKNKPYFHMIWHIFIVLASFLHMIGIFYFM

SEQ ID NO: 4837 - protein, 326 aa, Staphylococcus epidermidis
RGESHMIKQNLKMRYTIVLLLLIFSTIFSLCIGSVMINPIHAVTGFFLHNDFILNEYRIPRTLLGLLIGSSLAISGSVIQGVIRNPLASPDVIGITKGASLAAVMIIMIFPSAPLFVLPLGSFIGALTISIILSVLISKFDVKGSKLALIGLAIGAICTAIVQFLLIRNPLDANNALLWLTGSLYGHNIVNFYSLLPWFIITVPIVLLLGYQLDILNLGDHVAIALGARVKILKMILLVLAVMLAGASIAVVGGISFLGLIAPHIARQLVGHKNIHVIIMSGLVGAILLTFGDGLARGIQPPLDIPVGVVIAIIGAPYFLFLLRKM

SEQ ID NO: 4838 - protein, 138 aa, Staphylococcus epidermidis
VKFLASQLFKRGFFIDYLGVDISKRSSVVAHYKNEKFQKEFFIQNNKNGYNYLLKYLNDLDHPQLIFESTGIYSRSMERFCCVNQINYIQMNPLEAKFKTSALRSWKTDQADAHKLACLGPTLKQTDNLPICALMSLF

SEQ ID NO: 4839 - protein, 99 aa, Staphylococcus epidermidis; identical to SEQ ID NO: 3070

SEQ ID NO: 4840 - protein, 121 aa, Staphylococcus epidermidis
YPSPYCLLVIKTPTVPSPINEARLSTVDLPGKVNKGRMIGLKMGPSNSNRPYSINKGKKIAANKNTATRVGNKLENTNPPVSSDLIISGPIFKNVNQEKKTANTLKTSHPILTLKALLIKP

SEQ ID NO: 4841 - protein, 100 aa, Staphylococcus epidermidis
RLPPTYYRGCWHVVSRGFLIRYRQDVHSYLHICSSLITEFYDPKTFITHAALLRQAFAHCGRFPTAASRRSLDRVSVPVWPITLSGRLRIVALVSRYPTN

SEQ ID NO: 4842 - protein, 359 aa, Staphylococcus epidermidis
GGFTLLTVNQVKEIVGALKDPIIDVPLRESEGIVDVSIKDNINHVSVKVAMAQLGGQPQLDLQMAIVKALKENGANTVGIRFEELPSEVVERYIGKGSEKPKTIEELLSQNNPVEFISIASGKGGVGKSTVAVNLAVALAREGKKVGLVDADIYGFSVPDMMGIDERPGIDGKEIIPVERHGVKVISMAFFVEENAPVIWRGPMLGKMLTNFFTEVQWGELDYLLLDLPPGTGDVALDVHSMLPSSKEIIVTTPHPTAAFVAARAGAMAKHTEHTILGVIENMSYFESKETGKKEYVFGKGGGKKLSDELETQLFAELPLEQPTWNPNDFSPSIYQSDDRLGELYTLIARKVIVSTQKQ

SEQ ID NO: 4843 - protein, 200 aa, Staphylococcus epidermidis
SNFTRRKNARAWLVMIKIGVLALQGAVREHIRHIELSGYEGIAIKRVEQLDEIDGLILPGGEFTTLRRLMDLYGFKEKLQQLDLPMFGTCAGLIVLAKNVENESGYLNKLDITVERNSFGRQVDSFESELDIKGIANDIEGVFIRAPHIAKVDNGVEILSKVGGKIVAVKQGQYLGVSFHPELTDDYRITKYFIEHMIKH

SEQ ID NO: 4844 - protein, 97 aa, Staphylococcus epidermidis; identical to SEQ ID NO: 3072

SEQ ID NO: 4845 - protein, 116 aa, Staphylococcus epidermidis; identical to SEQ ID NO: 3060

SEQ ID NO: 4846 - protein, 64 aa, Staphylococcus epidermidis
FNYLIAMIDNAIKNCNCIMLYQAVQSLNNYTIMASKIIRNLYIILSIKFVSVIKIWLNMELSFE

SEQ ID NO: 4847 - protein, 492 aa, Staphylococcus epidermidis
IWNYHLNKKEYMFMASYELSKTKRNLIVSVMLISAFVAILNQTLLNTALPHIMRELNINENTSQWLITGFMLVNGVMIPLTAYLMDKVKTRPLYLGAMGSFLIGSIVAAIAPNFGVLMIARVIQAVGAGILMPLMQFTLFTLFSKEHRGFAMGLAGLVIQFAPAIGPTFTGLIIDNASWRVPFIVIVGIALVTFIFGFVSISSYNTTKETKLDKKSVIYSTLGFGLMLYAFSSAGNLGFSNPIVLCSLLISLIIIGIFVKRQITISNPLLNLKIFNNKIFCFSTITSMIIMLSMVGPALLIPLYVQNALGLSALLSGLVIMPGAIINGIMSVFTGKFYDKYGPRPLIFTGFILLISCTFLLCFLKVDTSYTYLIVIYAIRMFAVSLLMMPINTTGINALKTEDISHGTAIMNFGRVMAGSLGTALMVTFMSIGAQWVVSSSEHASKEMIQRQSVAVGVDVSFALVTVFVIIAFVLALFIKEPNHLTHNSRKV

SEQ ID NO: 4848 - protein, 404 aa, Staphylococcus epidermidis
NYVYIRSVIMLDKNQLEKYNQEHLYEYEKLMSSNEKNALDEKVDQLNLAEIQDLYQDLYVNRKTIDDVSSVSEVKYEVKSRLNEEERHTYEQKGYEAIRNGEFAVLLMAGGQGTRLGYKGPKGSFEIEGTSLFELQARQLIRLKEETGHTINWYIMTSDINHKDTIEYFKQHKYFNYDANHIHFFKQDNIVALSEEGKLVLNRDGHIMETPNGNGGVFKSLKKAGYLDKMQQDHVKYIFLNNIDNVLVKVLDPLFAGFTVTQSKDITSKTIQPKDSESVGRLVNVDCKDTVLEYSELDTDIANQFNNANIGIHAFKLGFITSAVDRELPYHLAIKQLKQLDENFGVVERPTLKFELFYFDIFRYGTSFVTLQVPREEEFSPLKNKEGKDSVHTATEDLKRMGLI

SEQ ID NO: 4849 - protein, 142 aa, Staphylococcus epidermidis
PKLKPAKTTAKAISNGSFKPNIIIRLLTNKTKNEQIYNVFLVKCASILPKLKLSVIQATDNGNITNPLCKGDKLSFSCKYTGIYKLYPISVIAISKSVIKTRTIDMLNSFVGRNGCSILFSILNSSHKTAKAKIIENMLKII

SEQ ID NO: 4850 - protein, 75 aa, Staphylococcus epidermidis
HSDKFNSTSYYVNFFKSIHIYSIHFYLFISICNLKYITLYICIILNNYVKNTIRYLLTFSKSILTLFHLSSSIRI

SEQ ID NO: 4851 - protein, 74 aa, Staphylococcus epidermidis; identical to SEQ ID NO: 3074

SEQ ID NO: 4852 - protein, 181 aa, Staphylococcus epidermidis
NMLKYFYKGEQNMTGKTHASCGFLVGAITTQYFHTDIFTSISVIVLSVISSILPDICHTQSKIGRRFRLTSFFVRILFGHRTFTHSLLFIIGISFLLYFIQTPMYYMVAIVIGMFSHVILDILTPRGVKLLYPLPFNIVSPIHFKTGGLVDVSLATALSVGAIYTLFQPYLNTMMHYWLIK

SEQ ID NO: 4853 - protein, 454 aa, Staphylococcus epidermidis
LKVNQPLYLSLYEKLKNQIIEGQYQSNDRFPSKRQLSNYLSVSHTTIEHAYQLLVDEGFIYSKPRSGYFVSDIESLPVIHRQTNQLNTDNLEKKQRQYKYAFNLAEIDSESFPMHIFRKYAKDVFEDHQLSLLQRGERQGEYILRQQISHYLFNSRGVTCHPNQIIVGSSTSQLLDMITNLLKKEEFIIEQPSYPPIKHTLDKKGISYIQVPVEQNGIQIDPILNTNNNILYITPSHQFPTGYVTNLKKRTQLINWSHQAKQRYIIEDDYDSEFRYFGKPIPALQSLDTKGKVIYISTFSKSLYPSCRIAYIVLPQNLMHKYNNQKYKEGNTVPVHVQHMVAQFMISGKFERHLNKMRKIYRDKLDYILKRLKPYNTQIKIEGALTGMHFTITVNNGLSMKQCLKNAKKNNLKLKPYHYENYSKVYPKFILGFGGIKKEELEDHVNALIHSLVI

SEQ ID NO: 4854 - protein, 160 aa, Staphylococcus epidermidis
GRTKVMKFLKNKSYHLLVTLIVLTIFVISGAIFLTFLGFGLYGLSRILIYLHLGDFSYNKGFYDNLIYYGSYIVLGYFTLFSIEHLMDYFKKNLPKNPYFQGINFHLISYIVTTIMFYFIVHIHYVHVNIHFWVIMIIIGFLFVCKEVFYPESKNLNNKK

SEQ ID NO: 4855 - protein, 303 aa, Staphylococcus epidermidis
SIRKGVSSMSKIVGSDRVKRGMAEMQKGGVIMDVVNAEQAKIAEEAGAVAVMALERVPSDIRAAGGVARMANPKIVEEVMNAVSIPVMAKARIGHITEARVLESMGVDYIDESEVLTPADEEYHLRKDQFTVPFVCGCRNLGEAARRIGEGAAMLRTKGEPGTGNIVEAVRHMRRVNSEVSRLTVMNDDEIMTFAKDLGAPYEVLKQIKDNGRLPVVNFAAGGVATPQDAALMMELGADGVFVGSGIFKSEDPEKFAKAIVQATTHYQDYELIGKLASELGTAMKGLDINQISLEERMQERGW

SEQ ID NO: 4856 - protein, 459 aa, Staphylococcus epidermidis
IYMNGFKKVDIVRGRIKFITMSLLGIILFLVPIPVVQDGKQQTTLPIAFLAGLLKDWLGGIMPILIVTIITVSGILTILCSTIYKNKLNPQGLMSSAFNVKIGWLVLRVLAVFFSWLTFLNIGPEMIKSEDTGGLVFSSLLPTLVAVFLFAAIFLPLLMEYGLLELLGPIFRPIMRPLFTLPGRSTVDNLASFIGDGTVGVLITSRQYGEGYYSRREATVISTTFSVVSITFAIVIAETIRMQDQFFYFYLTVVISCLIAAMIMPRIWPLKNIPDEYAKEVSEEARNEQLPEGKTALKYGFDLATEVGIKSPGFKEFLISGFKTVVDMWFVILPVVMSIGTIATIIANYTPVFEIIGKPFVPVLELLQIPEAHEASQTILIGFADMFLPSILIEGVQNDVTRFVIGALSISQLVYLSEVGGVILGSKIPVSISKLFMIFLIRTIITLPIIALLAHLFIG

SEQ ID NO: 4857 - protein, 348 aa, Staphylococcus epidermidis
VRWKTMTMVNKDSQSAIEQKKKKRTTLTFIVGVCLLFISVYLNLAIGSSKIQFNDILSYVTGHTNTKATFLIHNVRMPRMLAGLIIGGALAIAGLLMQAITKNPLASPQIFGVNAGASFVIVLITVLIPSLGSYSTILAIIGAFLGGFTVYTLSGSTKSITPIKLALAGMAIHLFFSSMTQGIIILNEDSNDTVMFWLVGSLAGIKWQQIIFILPFLLLAIFVTIFMGRQLTILELGDDIARGLGQRTEIVRMIVGILVVVLAGVSVSIAGPIGFVGLIVPHIVKRYINKNYVLMIPLTFIFGATLLLISDVLCRLITYPFESPVGIVTSFVGAFYFLFITVRGVNRI

SEQ ID NO: 4858 - protein, 450 aa, Staphylococcus epidermidis
KGSFFMNLKSIITVMALILIMFMAAIETSIISLALPTIKNSLNAGNLVSLVFTVYFIALVIANPIVGELMSRFKIIYIAVVGVLLFALGSLMSGLSQTFTFLIISRTVQGFGAGVMMSLSQIVPKLAFEIPLRYKIMGIVGSVWGISSIIGPLLGGAILEFASWHWLFYINIPIAIVAIILVLMTFHFPDETQVQQSRFDIKGLIIFYIFIALLMFGLLNQHHIIFNIFSIILALAVLWLLFKIENSIEQPFLPTKEFNISIVLVFITDLLIAITLMGYNLYIPVYLQEKLSLSPLQSGFVIFPLSVAWITLNFNLGKIEAHFTRKTLYICSFFVLLVSSLMIMFGLKLPLLIAFAVVFAGLSFGYIYTKDSVIVQEETSPKNMKKMMSFYALTKNLGSSVGSTIMGYMYALNVGLFGSNLHNVLGLVLIIAVCLIVMWMTLYKSNTIQS

SEQ ID NO: 4859 - protein, 74 aa, Staphylococcus epidermidis
AHGFKFSFTPLPGYFSPFPHGTGSLSVTREYLALGDGPPRFRRNFTCSVVLRIHSRENMFSTTGLLPSLIHLSR

SEQ ID NO: 4860 - protein, 60 aa, Staphylococcus epidermidis
RASWQIRKRPVWKKLNAVKNQRVDILDRDLWARSRGLISSEEMAKELVELSKKDSKKDNK

SEQ ID NO: 4861 - protein, 68 aa, Staphylococcus epidermidis; identical to SEQ ID NO: 3076

SEQ ID NO: 4862 - protein, 76 aa, Staphylococcus epidermidis
TYNGISKAGPTIDNIMIIEVIVEKQNILLLNIFKFNNGLEIVICRLTKMPMMIKLIKSEQRTIGLEKPRLPALLKA

SEQ ID NO: 4863 - protein, 119 aa, Staphylococcus epidermidis
MINIILKKIDLEVIRMFVVTNRITVKKGYAKQMAPNFTKGGPIESLKGFEGIEVWQIDKDDYSEDMYVNSWWETEEDFKNWVNSDVFKQAHKNTGKSEDSPVIKSEIVKSNVLSSLNRR

SEQ ID NO: 4864 - protein, 92 aa, Staphylococcus epidermidis
LKEVFSMAMTVKKNDNEVRIQWRVADIKIPNNEIKNVTQDQDIHAVPEENGKEISRIGSTFGKTNRVLIDTDQHLYIIYTQNDQKVYNELTK

SEQ ID NO: 4865 - protein, 62 aa, Staphylococcus epidermidis
AVLFVYDLYFYFLMGHQNDIVTSIRACTLICNVSGSITKKYDIETIKFTTSYVIKIRNKVRL

SEQ ID NO: 4866 - protein, 171 aa, Staphylococcus epidermidis
SNGSKYSKESSKSSFKSSFTKRFVTSCCGFSNTLLTAPCSITLPFSITATSSQILRITCISCVISTIVKFCCSLTFNNKSRISSVVCGSNALVASSHNNTSGSLANALAIPTLCFCPPDNSDGYALSRPFRPTSSMSSNAFCLARPLGTPAISNGNVTFFNTFLDHSRLKC

SEQ ID NO: 4867 - protein, 82 aa, Staphylococcus epidermidis
LMFPLVEFCISNMAKGSDVVFEKLENDPNIDVLEYGCLQNCGLCASSLYALVDGDIVEGNTPDDLLKNIYQHIEDNDITNLL

SEQ ID NO: 4868 - protein, 253 aa, Staphylococcus epidermidis
MSSTLEIKDLHVSIEDKEILKGVNLTINTGEIHAIMGPNGTGKSTLSSAIMGHPSYEVTQGEVLLDGVNILELDVDERAKAGLFLAMQYPSEITGVTNADFMRSAINAKREEGQEINLMQFIKKLDKQMDFLDIDKDMAQRYLNEGFSGGEKKRNEILQLMMLEPKFAILDEIDSGLDIDALKVVSKGINQMRGEEFGALMITHYQRLLNYITPDKVHVMYGGKVVKSGGPELAKRLEEEGYEWVKEEFGAAE

SEQ ID NO: 4869 - protein, 97 aa, Staphylococcus epidermidis
LNATSAPSTIFFPKTLITFSKFIPDINPPTSALINKLMTTFNRHKHSMIINMTAITTAFIILPHPLSLYRTKVFIKYILARHIFNVNVKKDSTIIYI

SEQ ID NO: 4870 - protein, 65 aa, Staphylococcus epidermidis
MVNQHKISNMLTVETVCSLGANDGVGIVYGRDIAGKKAAFLKKVIDTRAIYKLGGIGLAFKKGKF

SEQ ID NO: 4871 - protein, 74 aa, Staphylococcus epidermidis
NGFHCKSVEDITETQAIANNEVKGKDLIKHIKITLGDFKDFQVKHDFDDANLLNMIAPVATMASKVKDMPSDCY

SEQ ID NO: 4872 - protein, 260 aa, Staphylococcus epidermidis
LVKHYQAYLIDLDGTMYKGTDEIDGAAQFIDYLNNNHIPHLYVTNNSTKTPVQVTEKLREMHIDAKPDEVVTSALATADYISEQHPNATVYMIGGHGLITALTDAGLSIKNDEHVDYVVIGLDEKVTYEKLSIATLAVRNGAKFISTNPDVSIPKERGFLPGNGAITSVVSVSTGIQPEFIGKPEPIIMSKSLDILGLEKSEVAMVGDLYDTDIMSGINVGIDTIHVQTGVSTYEDIQSKEIPPTYSFKDLNVAIAELEK

SEQ ID NO: 4873 - protein, 453 aa, Staphylococcus epidermidis
STIKYINFKEGDHVMELTIYHTNDIHSHLNEYARIQAYMAKHRPQLEHPSLYIDIGDHVDLSAPVTEATVGHKNIELLNEAHCDIATIGNNEGMTISHDALQNLYNDADFKVICTNVIDEEGHLPHHITSSYIKEIKGTRILFVAATAPFTPFYRALDWIVTDPLAAIKDEINAHQGEYDLLMVMSHVGIFFDEKLCQEIPEIDVIFGSHTHHHFEHGEINNGVLMAAAGKYGYYLGEVNITIENGKIVDKIAKIHPIETLPLVETHFEEEGRALLSKPVVNHHVNLVKRTDVVTRTSYLLAESVYEFSRADCAIVNAGLIVNGIEADKVTEYDIHRMLPHPINIVRVRLTGKQLKQVIQKSQKQEYMHEHAQGLGFRGDIFGGYILYNLGFIESEDRYFIGDEEIQNDKQYTLGTVDMYTFGRYFPLLKGLSTDYIMPEFLRDIFKEKLLKL

SEQ ID NO: 4874 - protein, 232 aa, Staphylococcus epidermidis
NMGKSYGEIFHEMVTMPNVQWPEVWQAILETLYMTVVSTLFAFVFGLILGVLLFLSAKSNSLAAKIFYTIVSFIVNLFRAIPFIILILLLIPFTSILLGTISGPTGALPALIIGAAPFYARLVEIAFKEIDKGVIEAAWSMGANTSIVVRKVLLPEAMPALISGITVTAIALVGSTAIAGVIGAGGLGNLAYLTGFTRNQNDVILVSTVFILIIVFIIQFLGDWLTNKIDKR

SEQ ID NO: 4875 - protein, 149 aa, Staphylococcus epidermidis
RGDKRMYFVDKDKLTQKITYLQKLTEDYNDNKRNLYAFERIGQMLIESSVDIGNMIIDGFILRDPGNYKDVIDILELENVISKETQSHINRTIDVRKQFAHHYIDLNMNKIEPLFDDALPYYKQFIQEVGQFLENENVPITAFGKGANN

SEQ ID NO: 4876 - protein, 351 aa, Staphylococcus epidermidis
YELNLKEKCIMIIAIILLIFVSFFFSGSETALTAANRTKFQTEAKKGDRKAQGLTKLLDKPSEFITTILIGNNVANIILPTLVTILAIDIGVNVGIASAIVTIVIILISEVIPKSIAATFPDKISKLVYPIIHICVIVLKPITILLNKMTDGINHLLSRGQPVEKRFSKEEIRTLLNIAGREGAFNEIENTRLQNVMDFEQLKVKDVDTTPRINVVAFSKEVTYDEAYDTVMNNPYTRYPVYDENIDDIIGVFHSKYLLAWSKHKEESITNYASSPLFVNEHNRAEWVLRKMTVSRKHLAIVLDEFGGTDAIVSHEDLIEELLGMDIEDEMDREEENKLKHQKFPQSMMHR

SEQ ID NO: 4877 - protein, 355 aa, Staphylococcus epidermidis
SMKNLVLLGGGYGNMRIMSRILPHSIPEGYHLTLIDRMPFHGLKPEFYALAAGTKSDKEVRIQFPDSSQINTVYGEISDIDLDEQMITVGNSKIDYDELIIGLGCEDKYHNVPGAEAYTHSIQTLSKSRETYHRISELPKGARVGIVGAGLSGIELASELRESRSDLEILLYDRGPRILRNFPEKLSKYISNWFSKHNVTVVPNSVIDRVEPGKIYNNGKPENIDLVVWTAGIQPVEIVRNLPIDMSTTGRVIINQYHQVPTYRNVYVVGDCANLPHAPSAQLAELQGEQIAEVLKKQWNNEPLPDKMPEIKVQGFLGSLGDKQGFAYIMDRTVTGRLASILKSGVLWRYKYHNG

SEQ ID NO: 4878 - protein, 279 aa, Staphylococcus epidermidis
TLKKRGLYSMKKLFGIILVLALTIALAACGGGKDKEKTITVGASPAPHAEILEKAKPLLKKKGYDLKIKPINDYTTPNKLLDKGEIDANFFQHTPYLNTESKEKGYKIESAGNVELEPMAVYSKKYKSLKDLPKGATVYVSNNPAEQGRFLKFFVDEGLIKLKKGVKIENAKFDDITENKKDIKFNNKQSAEYLPKIYQNQDADAVIINSNYAIDQKLSPKKDSIALESPKDNPYANLIAVKKGHKDDKNIKVLMEVLQSKEIQDYIKDKYDGAVVPAK

SEQ ID NO: 4879 - protein, 428 aa, Staphylococcus epidermidis
YLLEGKLIYRKVVTIMAEHSFDVKAVIKDFPILEQKVNNKRLAYLDSTATSQTPVQVLNVLDDYYKRYNSNVHRGVHTLGSLATDGYENARETVRRFINAKYFEEIIFTRGTTASINIVAHSYGDANISEGDEIVVTEMEHHANIVPWQQLAKRKNATLKFIPMTKDGELQLDDIKATINDKTKIVAIAHVSNVLGTINDVKTIAKIAHEHGAVISVDGAQSAPHMALDMQDIDADFYSFSGHKMLGPTGIGVLYGKRELLQNMEPVEFGGDMIDFVSKYDATWADLPTKFEAGTPLIAQAIGLAEAIRYIENLGFNAIHQHEKELTEYAYEQMLTIDGLEIYGPPKDRRAGVITFNLADIHPHDVATAVDTEGVAVRAGHHCAQPLMKWLGVSSTARASFYVYNTKEDVDQLVQALKQTKEFFSYEF

SEQ ID NO: 4880 - protein, 391 aa, Staphylococcus epidermidis
DYKERDNLACHMFIAFIYIVGWLKYYESLGELEMAQDRKKVLVLGAGYAGLQTVTKLQKELSADAAEITLINKNEYHYESTWLHEASAGTINYEDLLYPVEKTVNKNKVNFVVAEVTKIDRNAKRVETDKGVYDFDILVVALGFVSETFGIDGMKEHAFQIENVLTSRKLSRHIEDKFANYAASKEKDDKDLSILVGGAGFTGIEFLGELTDRIPELCSKYGVDQSKVKLTCVEAAPKMLPMFSDDLVSYAVKYLEDRGVEFKIATPIVACNEKGFVVEVNGEKQQLEAGTSVWTAGVRGSHLMEESFEGVKRGRIINKQDLTIEGHNDIFVIGDCSAFIPAGEERPLPTTAQIAMQQGEHTASNIKRLLNGESTQDFQYVNRGNCMFIRC

SEQ ID NO: 4881 - protein, 63 aa, Staphylococcus epidermidis
MAEDKFEQAKGNIKETVGNATDNKELEKDGKGDKASGKAKEAVENVKEKANDVIDKFKGNKGD

SEQ ID NO: 4882 - protein, 80 aa, Staphylococcus epidermidis
LIMEFREQVLDLLAEVAENNIVKENPDVEIFEEGIIDSFQTVGLLLEIQNKLDIEVSIMDFDRDEWATPNKIVEALEELR

SEQ ID NO: 4883 - protein, 85 aa, Staphylococcus epidermidis
KETCHMPTENPTMFDQVAEVIERLRPFLLRDGGDCTLVDVEDGIVKLQLHGACGTCPSSTITLKAGIERALHEEVPGVIEVEQVF

SEQ ID NO: 4884 - protein, 349 aa, Staphylococcus epidermidis
RFKCSYCRIRKIKYHLSVFEINRGVHMNKILVTRQIPQHYVEQLKKIGQVVMWEHDLTPMSRESFLANVEDATACVITLSEHIDEEVFLRAQQLKVIANMAVGFDNIDISLAKKHGVVVTNTPHVLTETTAELGFTLMLTVARRIIEATSYIQKGKWKSWGPYLLSGKDVYGATVGIFGMGDIGKAFARRLQGFDARIIYHNRKRDLNAERDLNATYVTFKSLLEQSDFIICTAPLTKETENQFDARAFNKMKNDAVFINIGRGAIVDEEALLEALKNHEIQACGLDVMRQEPIQPNHPILKLPNAVVLPHIGSASQVTRNRMVQLCIDNIKAVLNNDAPITLVTSLHF

SEQ ID NO: 4885 - protein, 412 aa, Staphylococcus epidermidis
ENCRGCKRMIPYGTFTFFLIAFIVLIPVIILGFLGKRSYIYNGISTAIMIVIIFASDKHNLLGQKYLSAQLFCFIIYVIWQVALIMYYYQSRQKKNTFTKFVTIMVLSILPLAIVKILQSSWLGGHQIHFHESKLIEFVGFLGISYVTFKSVQLIMEIRDGSIKEIKVGKLIQFISFFPTISSGPIDRYKRFVKDDKKVPSGAEYRELVVKAIHMIMLGFLYKYIIAYLIQTYAVNPLQLNLHGFTHMWLYMYAYSLYLFFDFAGYSLFAIAVSYLYGIKTPPNFKQPFKAKNIKDFWNRWHMTLSFWFRDCIYMRSLFYMSRKKLLKSQFAMSNVAYFLNFFIMGVWHGLEVYYIVYGLYHAALFIGYGYYERWRKKHPPRWQNGFTTAISIIITFHFVTFGFLIFSGKFI

SEQ ID NO: 4886 - protein, 84 aa, Staphylococcus epidermidis
RIISNIDTNIINTPKYKLNESSVRYLLKKEPTKDPGSSPNRNIEPFFISTCLVFKYPNEEDNPVTIRITEEVPIAICVVIPCRR

SEQ ID NO: 4887 - protein, 93 aa, Staphylococcus epidermidis
RSVRVMIDMYLYDDEEQSQVQFVGFVGEHSRYDLMLVQTDRHYGKTLVLNMQTNQFGIIGSDDIEEEGYISHILGVSKEEADEIIEYLNEVIQ

SEQ ID NO: 4888 - protein, 70 aa, Staphylococcus epidermidis
STSRQQIILLTEIKLSELGTEFVISSRVTRFIKEIPRRNVFFVYFFDSQYIKCLGTMFCILSILLFYLAS

SEQ ID NO: 4889 - protein, 162 aa, Staphylococcus epidermidis
NKRRSFSLMNFNNLDQLYRSVIMDHYKNPRNKGVLDNGSMTVDMNNPTCGDRIRLTFDIEDGIINDAKFEGEGCSISMSSASMMTEAVKGHSLGEAMQMSQEFTKMMLGEDYEITEEMGDIEALQGVSQFPARIKCATLAWKALEKGTVEKEGKSEGTTEED

SEQ ID NO: 4890 - protein, 421 aa, Staphylococcus epidermidis
NCRSFRRVTMKLKPFLPIIISGVIFIIFLFLPASWFTGLVTNKTLADNRISLTDQVLKGTLIQNKLFESNKYYPIYGSSELEKDDPFNPGIALNKQNASKETFLIGAGGSTDLINAVELAAQYDNLKGKKFTFIISPQWFTNHGLTNQNFDARMSQSQINQMFNQKDMPANLKKRYAQRLLQFPHAHNKSYLREQAKHPNDVSGNYISSFKENQLTKIEAIKSLFSFTKPPLAEVKPATREDASWDEMKHKAADIGKANTQSNKYDIRDPYWKLIKQNKRKIKRDYEFNINSPEFQDLKLLVQTLHAAGADVQYVSIPSNGRWYDHIGIKKDRREAVYKKIHSTVVDNGGKIYDLTNKDYEKYVISDAVHIGWKGWVYVDQQIARHMDGHAPKNHEVDYSKNKPPHKHHNDRQDDQHQGNK

SEQ ID NO: 4891 - protein, 357 aa, Staphylococcus epidermidis
ESIFNLITKQHKEAINVIKLNQIVKRYHTKDKDVLAVDHVDLNIESGSIFGVIGFSGAGKSTLIRMFNNLESPTSGEIIIDGDNISQLSKSQLRKKRQKVSMIFQHFNLLWSRNVLKNVTFPLEIAGVPSGLAKQKALELIELVGLKGRESAYPSELSGGQKQRVGIARALANDPDVLLCDEATSALDPQTTDEILDLLLKVREQQNLTIVLITHEMHVIRRICDEVAVMENGKVIEQGAVSKVFENPQHEVTKRFVKDDLNDDFEDSLEYLEPLDHDAYIVRLNFTGENTTEPIISYMTKTHNIDVNILEADIKNTKNGSLGFLVIHIPHISEEHFKQFKHNLHEQHVNVEVLKHG

SEQ ID NO: 4892 - protein, 507 aa, Staphylococcus epidermidis
LIIIVIQNEERRIYMQFFINQDTPTSIETIVVGVPDHLNQLGEIKYHKTLIKERLETLKQYHVINSSIGKISSTLIYIDEKPKRLLTVGLGNLKILSYQRLLKVWGQLFQYLKDVHVTDCELLLDTFKSKHGNIVEICQTLGLQSAQSIFEFDHYKSDKKPPYQGRVYIQTTEHNIETKINEGQQLGESINYARELSQIPPNILTPQYFAEEIKKHFEGSSVSVDIKDHRQIIDEGFGLIHAVGKGSNHGPRLITVSYYGAEADEPPISLVGKGITYDSGGYSIKSKIGMQTMKYDMCGAANVIGMIDVISKQNLPVNIVGIIASAENMIGESSMKPDDVFTALNGETVEMLNSDAEGRMVLGDAVFYATQFKPQLILDFATLTGAAIVALGDDKAAAFQSHAENELKNLLTVARHVDEKVFELPITETERHLIKQSDVADLVNHTNGQGKALFAAAFISHFSGDIPHIHFDIAGPATTKSATYKGPKGPTGYMIPTVVEWLQQKYK

SEQ ID NO: 4893 - protein, 290 aa, Staphylococcus epidermidis
KEIIMKKFKWINIFKGFGMGTSDLVPGVSGGTIALLLGIYDDFISSISGLFSRRFWPSLKFLLPILVGMLIAIGLLSQLFNYLLSQHHIPTMLFFTGLILGIIPYLLTISNFKKNFSIIHYFILLLGIAIIVVFALLNHGDKHSGETLTLSFSLIIKYFIAGVFASSAMLLPGISGSFMLLVFGVYGTLMYAISELLHFNLNALPIILIVGFGIVTGFMISSRLIQYCLHQHPTMTFALIIGFVIGSLYAVFPGFPKDLIQWIISFFLLITGFLVSYVLGKITAKNEASF

SEQ ID NO: 4894 - protein, 132 aa, Staphylococcus epidermidis
GENMIKVDQQYFELIEEYRECFDEEIFSARYSDILDKYDYVVGDYGYDQLRLKGFYKDSNKKAEISKRFSSIQDYILEYCNFGCPYFVVRRLSPNEFIEEIDDKEDIIDKLHDVKIQPTIQDTEKHTQAIDQ

SEQ ID NO: 4895 - protein, 291 aa, Staphylococcus epidermidis
CGIMLLVINMIEIGLTGWGDHDTLYEDLERKTDKLKTYASHFPIVELDASYYAIQPERNIIKWINETPNRFQFVVKIHQALTLHADYRDYAESRDILFKQFKEMINPLKEHNKLAMVLVQFPPWFDCNVQNINYILYVRKQLTDIPMSIEFRHQSWFDNQYKEQTLSFLTQHQIIHAVVDEPQVKEGSVPLVNRITSEIAFVRYHGRNHYGWTKKDMTDQEWRDVRYLYDYSNDELADLARKVEILNQKAKKVYVIFNNNSGGHAANNAKKYQNILDIDYEGLAPQQLKLF

SEQ ID NO: 4896 - protein, 109 aa, Staphylococcus epidermidis
GILMTKISVVVYGAEVVCASCVNAPTSIDTYQWLQALLLRKFPQHHFEFTYIDIRNDTENLTDHDMQFIERINEDELFYPLVTMNDEYVADGYIQYKQITRFIKSYFTM

SEQ ID NO: 4897 - protein, 117 aa, Staphylococcus epidermidis
LLLIARNFSFIKQLYTTYLKNNQFVQLKMELNGYRDALYGGGKSAKSLMTKKDIKMSNKIANAMKRLEKVIDNSHEKIDARAIREYVNKYPIIEGQVIHINSCLDNDISGTYIYYSA

SEQ ID NO: 4898 - protein, 91 aa, Staphylococcus epidermidis
GRMINAVVIAVILMIILCLCRLNVVISLFISALVGGLISGMNLEKVINVFGKNIVDGAEVALSYALLGGFAALISYSRITDYLIVSYTTGN

SEQ ID NO: 4899 - protein, 322 aa, Staphylococcus epidermidis
CRYVIINEDILNRRVCVVMATRNEEILRKPDWLKIKLNTNDNYTGLKKMMREKNLHTVCEEAKCPNIHECWGARRTATFMILGAVCTRACRFCAVKTGLPNELDLNEPERVAESVELMNLKHVVITAVARDDLRDQGSNVYAETVRKVRERNPFTTIEILPSDMGGDYEALETLMASRPDILNHNIETVRRLTPRVRARATYDRTLQFLRRSKELQPDIPTKSSLMVGLGETMEEIYETMDDLRANDVDILTIGQYLQPSRKHLKVEKYYTPLEFGKMRKIAMEKGFKHCQAGPLVRSSYHADEQVNEAAKEKQRQGEEQLN

SEQ ID NO: 4900 - protein, 279 aa, Staphylococcus epidermidis
EANVMLLTIILLILIGGLSAILGSIVGIGGGIIIVPTLVYLGVNHHLLHGITTQIAIGTSSVILIVTGLSSSLGYLKTKQVDIKNGSIFLFGLLPGSLVGSFLSRYLTLDSFNLYFGVFMIFVSILLMIRHKIKPFKIFDKPKYARTYVDAEGKTYRYSVPPLFAFITTLFIGLLTGLFGIGGGALMTPLMLIVFRFPPHVAVGTSMMMIFFSSVMSSIGHIFQGHVAWGYSIILIISSVIGAQIGVRVNRSMKSDTVVMLLRTVMLIMGVYLIIKSFI

SEQ ID NO: 4901 - protein, 66 aa, Staphylococcus epidermidis
LNHVNSLLMLLSNQIKNAFSIFRKFEKAFVEMFFLSSSKVILYVNWHHLYFRQFARAFTNGIARKG

SEQ ID NO: 4902 - protein, 489 aa, Staphylococcus epidermidis
GRVVMADLINILNHFVQEQPEAVAVRHTNDELTYKQLDEESSKLAHLLQDSKKPMILYGHMSPYMIVGMIGAIKSGCGYVPIDTSVPKERVNMIIDKVQPEIIFNTSDETLEQTNAQVLKVSDIQDSQYPIVFDSQMKQNDVVYTIFTSGSTGEPKGVQIEYASLNEFAEWMVSLNKTGTGKEWLNQAPFSFDLSVMAIYPCLTSGGTLNLVDKDMIKKPKLLNEMLVQTPMNVWVSTPSFIEMCLLLPNLNEQQYSSLKQFFFCGEILPHKTAKALVERFPNSMIYNTYGPTEATVAVTSIQITEEILNQYNPLPVGVARPGTKLFATEEGELVIEGQSVSLGYLKNEEKTTAVFNFEDGVRTYHTGDKAKIEDGLWFIQGRIDFQIKLNGYRMELEEIETQLRQSKHVREAVVVPVYKNGKVIHLIGAVVPTEPVEDNLAMTTHIKHELKSRLPEYMIPRKFEWMEQLPLTSNGKLDRKKIAEVVNG

SEQ ID NO: 4903 - protein, 439 aa, Staphylococcus epidermidis
EEKVMTTKTLNISEEQLVDYSKAHNEPSWMTELRKKALKLTETLEMPKPDKTKLRKWDFDTFKQHHTTGDAYTQLTDLPKSVKEIIDVENSENLIIQHNNELAYTQVSDQAKHDGVIIEGLSEALVNHSDLVQKYFMTKAVDVDEHRLTALHTALVNGGIFVYVPKNTVVEHPIQYVVLHDDEQASFYNHVIIVTEESAEVTYVENYLSTTSGEDNQLNIVSEVIAGANSNVTYGSVDYLDKGFTGHIIRRGSADADASINWALGLMNEGSQIIDNTTNLNGDRSTSALKSVVVGTGDQKINLTSKIVQYGKETDGYILKHGVMKENASSVFNGIGYIKHGGTKSIANQESRVLMLSENARGDANPILLIDEDDVEAGHAASVGRVDPEQLYYLMSRGISRAEAERLVIHGFLDPVVRELPIDDVKRQLREVIERKVSK

SEQ ID NO: 4904 - protein, 471 aa, Staphylococcus epidermidis
NQGVIKMAKQAPDVGDYKYGFHDEDVSIFRSERGLTENIVTEISKMKEEPQWMLDFRLKALKLFYKMPMPQWGGDLSELDFDDITYYVKPSEHTERSWDEVPEEIKRTFDKLGIPEAEQKYLAGVSAQYESEVVYHNMEKELEEKGIIFKDTDSALRENEELFREYFASVVPAADNKFAALNSAVWSGGSFIYVPKNVKLDTPLQAYFRINSENMGQFERTLIIADEGASVNYVEGCTAPVYSTSSLHSAVVEIIVHKDAHVRYTTIQNWANNVYNLVTKRTFVHENGNMEWVDGNLGSKLTMKYPNCVLLGEGAKGSTLSIAFAGKGQVQDAGAKMIHKAPNTSSTIVSKSISKNGGKVIYRGIVHFGRKAKGARSNIECDTLILDNESTSDTIPYNEVFNDNISLEHEAKVSKVSEEQLFYLMSRGISEEEATEMIVMGFIEPFTKELPMEYAVEMNRLIKFEMEGSIG

SEQ ID NO: 4905 - protein, 135 aa, Staphylococcus epidermidis
YNEFVIKVKKLWEVFYMPTVILTEAAAFEVRDMLKNNDMSDGYLKIKVNGGGCTGLTYGMSAEAEPGENDEILEYYGLKVLVDRNDAPVLNGTTIDFKQSLMGGGFQINNPNAIASCGCGSSFKTAKVAGNPEQC

SEQ ID NO: 4906 - protein, 131 aa, Staphylococcus epidermidis
IMRSILLPYSIDSSYSNVNSGIILRRIREPSSDFINPVALCKALNVLSTSLSFPNTVKYTFACERSLVSSTSVIVKKPTLGSLTLLLTMSMISCFICSPTRSALILFIISPLFIFTLLTNKCEISDLMINY

SEQ ID NO: 4907 - protein, 64 aa, Staphylococcus epidermidis
RSLSKTRPPTTESYLYNILYLLYKHFKQNTSLLRIFVRIYCVIADTKTNKRTYIFCKNLKYTIY

SEQ ID NO: 4908 - protein, 706 aa, Staphylococcus epidermidis
ERRFIMSQEKKVFKTEWAGRSLTIETGQLAKQANGAVLVRYGDTVVLSTATASKEPRDGDFFPLTVNYEEKMYAAGKIPGGFKKREGRPGDEATLTARLIDRPIRPLFPKGYRHDVQIMNIVLSADPDCSPEMAAMIGSSMALSVSDIPFQGPIAGVNVGYIDGKYVINPSVADKEISRLDLEVAGHKDAVNMVEAGASEITESEMLEAIFFGHEEIKRLVAFQQEIIDHIQPIKQEFVPVERDEDLVEKVKSLTEDKGLKDTVLTFDKQQRDENLDALKEEVVGHFLDEEDPENETLVKEVYAILNDLIKEEVRRLIADEKIRPDGRKVDEIRPLESEVGLLPRAHGSGLFTRGQTQALSVLTLGALGDYQLIDGLGPEVEKRFMHHYNFPNFSVGETGPVRAPGRREIGHGALGERALRYIIPDTQDFPYTIRIVSEVLESNGSSSQASICGSTLALMDAGVPIKAPVAGIAMGLVTRDDSYTILTDIQGMEDALGDMDFKVAGTKDGITAIQMDIKIDGLTREVIEEALEQARQGRLAIMDHMLHTIEQPREELSAYAPKVVTMSINPDKIRDVIGPGGKKINEIIDETGVKLDIEQDGTIFIGAVDQAMINRAKEIIEDITREAEVGQVYHAKVKRIEKYGAFVELFPGKDALLHISQISQERINKVEDVLKIGDTIEVKITEIDKQGRVNASHKVLEQSKN

SEQ ID NO: 4909 - protein, 301 aa, Staphylococcus epidermidis
WRGLILDKIQETFLYMLKVERNFSEYTLKSYHDDLVQFNNFLEREHLQLETFEYKDARNYLAFLYSNQLKRTTVSRKISTLRTFYEFWMTQDNSIINPFVQLVHPKKEKYLPQFFYEEEMEALFQTVEHDNKKGIRDKVIIELLYATGIRVSELINIKLKDIDMNLPGVKVLGKGNKERFIPFGEFCRQSIERYLEEFQPKQLANHDYLIVNMKGDPITERGVRYVLNDVVKRTAGVNDIHPHKLRHTFATHLLNQGADLRTVQSLLGHVNLSTTGRYTHVSNQQLRKVYLNAHPRAKKGE

SEQ ID NO: 4910 - protein, 148 aa, Staphylococcus epidermidis
KRLLKNLVAKKSISSNGMKIPKVFVRNALSPSQVLEVIVDEENQSTVVVVPDYQLSLAIGKRGQNARLAAKLTSWKIDIKSESDAREAGIYPVIESEEVADEIVNSGDEDVEFDNVNLEETNLTSTELAAENDEDKKDKTEEDNDTES

SEQ ID NO: 4911 - protein, 111 aa, Staphylococcus epidermidis
RRDPKIMTKMKIFNLLGLAMRAGKIKSGESVILNELKKNQIKLVILASDASSNTLKQMNNKCNSYQVPLKVFGTRNELGLAIGKSDRVNIGITDNGFAKKLLSMIDEYGKE

SEQ ID NO: 4912 - protein, 526 aa, Staphylococcus epidermidis
NNDYGHIERIFKVNEEQRKAGTINILAERDRKAEKDYSKYFEQVYQPPSLKEAKKRGKQEVQYNRDFHIDEKYKGMGKGRTFLIKTYGCQMNAHDTEVMAGILNALGYSATSDINEADVILINTCAIRENAENKVFSEIGNLKHLKKERPDCLIGVCGCMSQEESVVNKILKSYQNVDMVFGTHNIHHLPEILEEAYLSKAMVVEVWSKEGDIIENLPKVRDGHIKAWVNIMYGCDKFCTYCIVPFTRGKERSRRPEDIIDEVRELAREGYQEITLLGQNVNSYGKDIEGLDYELGDLLEDISKIDIPRVRFTTSHPWDFTDRMIEVIAKGGNIVPHIHLPVQSGNNQVLKIMGRKYTRESYLDLVSRIKEAIPNVALTTDIIVGYPNETEEQFEETLSLYDDVQFEHAYTYLYSQRDGTPAAKMKDNVPLEVKKERLQRLNKKVGIYSQQAMSQYEGKIVTVLCEGSSKKDENVLAGYTDKNKLVNFKGPRESIGKLVDVKIDEAKQYSLNGTFIQEHQRSMVTQ

SEQ ID NO: 4913 - protein, 891 aa, Staphylococcus epidermidis
IYTYNINKDIRIRVVKIEMANITPMMQQYLKIKSEYDDCLLFFRLGDFYEMFFDDAKEASRVLEITLTKRDAKKENPIPMCGVPYHSADNYIETLINNGYKVAICEQMEDPKQTKGMVRREVVRIITPGTVMDQNGMDEKKNNYILSFIENEEFGLCYCDVSTGELKVTHFKDTATLLNEITTINPNEIVIKQALSEELKRQINMITETITVREDISDEDYDMNQLTHQLMHDTTQLLLDYIHHTQKRDLSHIEEVIEYAAVDYMKMDYYAKRNLELTESIRLKSKKGTLLWLMDETKTPMGARRLKQWIDRPLINKQQINDRLNIVEEFMDRFIERDTLRNHLNQVYDIERLVGRVSYGNVNARDLIQLKHSISEIPHIKALLNELGAQTTTQFKELEPLDDLLQILEESLVEEPPISIKDGGLFKNGFNAQLDEYLEASKNGKTWLAELQAKERERTGIKSLKISFNKVFGYFIEITRANLNNFQPEAFGYNRKQTLSNAERFITDELKEKEDIILGAEDKAVELEYELFVKLREHIKTYTERLQKQAKIISELDCLQSFAEIAQKYNYVKPTFSDDKVLHLENSRHPVVERVMDYNDYVPNDCHLDDETFIYLITGPNMSGKSTYMRQVAIISIMAQMGAYVPCDSATLPIFDQIFTRIGAADDLVSGKSTFMVEMLEAQKALTYATENSLIIFDEIGRGTSTYDGLALAQAMIEYVAQTSHAKTLFSTHYHELTSLDQMLKCLKNVHVAANEYQGELIFLHKVKDGAVDDSYGIQVAKLADLPNEVIDRAQVILNAFEQKPSYQLSHENTDDQQTVPSYNDFGRTEEEQSVIETHTSNHNYEQATFDLFDGYNQQSEVECQIRELNLSNMTPLEALIKLNELQSQLK

SEQ ID NO: 4914 - protein, 585 aa, Staphylococcus epidermidis
NHKYHGKWAVSKGEGIESTGEIFATAMNRKGYFLYGYRHFSSRIKGGHTNNKIRVSKSPVHAISDDLDILIAFDQETIELNHHEMREDSIIIADAKAKPQKPENCVAQLIELPFTSTAKELGTALMKNMVAIGATSALMDLNTSTFETLIDNMFSKKGNKVVDMNIQALNMGYDLMKQQVTNVNGDFTLENGSGHPHLYMIGNDAIGLGAIAAGSRFMSAYPITPASEIMEYMIANLPKVDGTVVQTEDEIAAATMAIGANYAGVRGFTASAGPGLSLMMESIGLSGMTETPLVIINTQRGGPSTGLPTKQEQSDLMQMIYGTHGDIPKIVVAPTDAEDAFYLTMEAFNLAEEYQCPVILLSDLQLSLGKQTVKTLDYNKIDIRRGEIIQSDIERAEDDKAYFKRYALTASGVSPRPIPGVKGGIHHVTGVEHNEEGKPSEAPMNRQNQMEKRMRKTESLVINNPVLLNEHEDEADILYIGFISTKGAIGEGAERLERHGVKVNTMHIRQLHPFPKDIVQQAINKASKVIVAEHNYQGQLSSILKMNTQVNDKLVNQTKYDGKPFLPYEIEEKGLEIAKELKELV

SEQ ID NO: 4915 - protein, 443 aa, Staphylococcus epidermidis
MSDFRRGKMTQKVNVVGAGLAGSEAAYQLAQRGIKVNLIEMRPVKQTPAHHTDKFAELVCSNSLRGNALTNAVGVLKEEMRHLDSLIITSADKARVPAGGALAVDRHDFAGYITDTLRNHPNITVLNEEVNHIPEGYTIIATGPLTTEHLAQEIVDITGKDQLYFYDAAAPIIEKDSINMDKVYLKSRYDKGEAAYLNCPMTEEEFNRFYDAVLEAEVAPVNEFEKEKYFEGCMPFEVMAERGRKTLLFGPMKPVGLEDPKTGKRPYAVVQLRQDDAAGTLYNIVGFQTHLKWGAQKEVIRLIPGLENVDIVRYGVMHRNTFINSPDVLNEKYELKGHDNLYFAGQMTGVEGYVESAASGLVAGINLAHKILDKGEVIFPRETMIGSMAYYISHAKNEKNFQPMNANFGLLPSLEKRIKDKKERYETQAKRALEYLDNYKQTL

SEQ ID NO: 4916 - protein, 139 aa, Staphylococcus epidermidis
YLIHYFDFYLNQPTWFLTKFSALRFSVTILFSYLYFQLKYLSKIKLFFYLSIQQMMIHLYGMEYLPTYVYTFASIILQFSTHIIDTRDFLYLISFPYITSLLYLGSKTMCYLQFHYVCAKLFVSDDIKKHLFVLNILVG

SEQ ID NO: 4917 - protein, 798 aa, Staphylococcus epidermidis
VLPQAKKRTSTKRKGNKKTNKKKQNETPLRYIFSIIVVILIILGAFQLGIIGRMIDSFFNYLFGMSRYLTYILVLIATIFITYSKQIPRTRRSIGAIVLQLALLFIAQLYFHFSHNITSQREPVLSFVYKAYEQTHFPNFGGGLIGFYLLKLFIPLISIVGVIIITILLLASSFILLLNLRHRDVTKSLFDNLKSSSNHASESIKQKREQNKIKKEEKAQLKEAKIERKKQKKSRQNNNVIKDVSDFPEISQSDDIPIYGHNEQEDKRPNTANQRQKRVLDNEQFQQSLPSTKNQSINNNQPSTTAENNQQQSQAEGSISEAGEEANIEYTVPPLSLLKQPTKQKTTSKAEVQRKGQVLESTLKNFGVNAKVTQIKIGPAVTQYEIQPAQGVKVSKIVNLHNDIALALAAKDVRIEAPIPGRSAVGIEVPNDKISLVTLKEVLEDKFPSKYKLEVGIGRDISGDPISIQLNEMPHLLVAGSTGSGKSVCINGIITSILLNTKPHEVKLMLIDPKMVELNVYNGIPHLLIPVVTNPHKASQALEKIVSEMERRYDLFQHSSTRNIEGYNQYIRKQNEELDEKQPELPYIVVIVDELADLMMVAGKEVENAIQRITQMARAAGIHLIVATQRPSVDVITGIIKNNIPSRIAFAVSSQTDSRTIIGAGGAEKLLGKGDMLYVGNGESTTTRIQGAFLSDQEVQDVVNYVVEQQKANYVKEMEPDAPVDKSEMKSEDALYDEAYLFVIEKQKASTSLLQRQFRIGYNRASRLMDDLERNQVIGPQKGSKPRQILVDLENDEV

SEQ ID NO: 4918 - protein, 290 aa, Staphylococcus epidermidis
LIQHTMLKLYWANFTTAQLHHLTSTYPDFLSENVFHQHDMIKRWLTERNSERLWNKYERFKELKLMDIIKEMKKANVSFTTYFDDNYPSLCKEMYDYPYVIFYKGNPQFFNHSHSLAVIGSRNATQYTSQSLNYLFPSFRQLNMAIVSGLARGADSVAHQTALKYLLPTIGVLGFGHCYHYPKATLNLRTKVERNGLVISEYPPFSPISKHKFPERNRLISGLSRGVLITEAEERSGSQITIDCALEQNRNVYVLPGSMFNKMTKGNLRRINEGAQVVIDESSILYDYLF

SEQ ID NO: 4919 - protein, 269 aa, Staphylococcus epidermidis
EDEQRMRILFIGDIVGKVGRKMITTYLPKIKQTYHPTVSIVNAENAAHGKGLTEKIYKQLLREGVDFMTMGNHTYGQREIYDFIDDAHRMVRPANFPDEAPGTGMRIIKINDIKLAIINLQGRSFMQDIDDPFKKADQLIEEAQKSTPYIFVDFHAETTSEKNAMGWYLDGRVSAVVGTHTHIQTSDDRILPHGTGYITDVGMTGYYDGILGINRDEVIQRFITSLPQRHVVPDDGRGVLSGVIIDLDKEGKTTQIKRLLINEDHPFQI

SEQ ID NO: 4920 - protein, 531 aa, Staphylococcus epidermidis
YTKQTLDKGGVYVNLLSLLLILLGIILGVVVGYIVARNLLHQKQVQARQTADDIVSYANKEADNIKKEKLLEAKEENQILKEQAENELRERRGELQRQETRLLQKEENLDRKSDLLDKKDEILEQKESKLEERQQQVDAKESSVQTLIMKHELELERISGLTQEEAVKEQLQRVEEELSQDIAILVKEKEKEAKEKVDKTAKELLATTVQRLAAEHTTESTVSVVNLPNDEMKGRIIGREGRNIRTLETLTGIDLIIDDTPEAVILSGFDPIRREIARTALVNLVSDGRIHPGRIEDMVEKARKEVDDIIRDAGEQATFEINVHNMHPDLVKILGRLNYRTSYGQNVLKHSIEVAHLSGMLAAELGEDVTLAKRAGLLHDVGKAIDHEVEGSHVEIGVELAKKYNENNIIINAIHSHHGDVEPTSIISILVAAADALSAARPGARKETLENYIRRLERLETLSESYDGVEKAFAIQAGREIRVVVSPEEIDDLKSYRLARDIKNQIEEELQYPGHIKVTVVRETRAIEYAK

SEQ ID NO: 4921 - protein, 266 aa, Staphylococcus epidermidis
EEFKMAVISMKQLLEAGVHFGHQTRRWNPKMKKYIFTERNGIYIIDLQKTVKKVEEAYNFVKQISEEGGKVLFVGTKKQAQESVKAEAERAGQFYVNQRWLGGILTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTGKMADAILEGQQGVSNEEVAAEQNINLDDKEESEQAETTEENTSVESN

SEQ ID NO: 4922 - protein, 138 aa, Staphylococcus epidermidis
LIIKSDISHLFVSKVKIKRGEMMNNIRAERVGEQMKQEIMDIVNNKVKDPRVGFLTITDVELTNDLSQAKVYLTVLGNDKEVDNTFKALHKATGFIKSELGSRMRLRIIPELTFEYDESIEYGNKIERMIQELHKNDK

SEQ ID NO: 4923 - protein, 84 aa, Staphylococcus epidermidis
YETNKNIGVVYSFMSINIDPEKFAELVVTSNPAKSDDAEDIAKESLILYINAYRLAEKYANIATNCYDTAEILKEINEVDLQLK

SEQ ID NO: 4924 - protein, 85 aa, Staphylococcus epidermidis
AKNKTTSNTIIEVRVNNDLYLININNTMIKINATNIHFTDLSDSAINMKPYMNTGIATKVYSLIDISLKCCMNNAINTLVDNAKK

SEQ ID NO: 4925 - protein, 328 aa, Staphylococcus epidermidis
RRNNIMKVIEVTHPIQSNQFITENVAMAFGFFDGMHRGHDKVFQVLDEKAKEHQLKKAVMTFDPHPSVVLNPERKRTTYLTPLSDKLEMIAEHGIDYCIVINFSSRFANVTSDDFIKNYIINNHVKEVIAGFDFTFGKFGKGNMTVLQESKAFNTTIVGKQEMDSEKISTTAIRQALTDGHLQKANDELGYIYRIKGTVVQGEKRGRTIGFPTANVQPSDDYVLPKKGVYAVSMEIGPESKLHRGVANVGVKPTFHDPTRAELVIEVNIFDFNENIYGERVTVYWHHFLRPEVKFDGIDPLVKQMNEDKAQAKHLLSIDFDDDISYNI

SEQ ID NO: 4926 - protein, 181 aa, Staphylococcus epidermidis
FMDNSLHATTIYAVRHNGEAAMAGDGQVTLGQQVIMKQTARKVRRLYEGKVLAGFAGSVADAFTLFEKFETKLQQFSGNLERAAVELAQEWRGDKQLRQLEAMLIVMNKDAILIVSGTGEVIAPDDDLIAIGSGGNYALSAGRALKRHAAQLSASEMAYESLKVAADICVFTNDNIIVETL

SEQ ID NO: 4927 - protein, 309 aa, Staphylococcus epidermidis
RCDNMYNGILPVFKKRGLTSHDVVFKLRKILKMKKIGHTGTLDPEVNGVLPICLGDATKVSDYIMEMGKTYHAMITLGKSTTTEDQTGDILETRAVDKNDINEDTIDQVLQQFEGHIQQIPPMYSSVKVNGRKLYEYARNNETVERPKRQVFIKDIHRISEVTFQEQTCHFEVEVTCGKGTYIRTLATDIGLKLGFPAHMSRLTRIASGGFQLESSLTIDQIKELHEHDSLHNELFPIEYGLKGLKSFQVKDSNFKKKICNGQKFHKKVLSQNVKEPFIFVDSSTQKVLAIYIVHPDKPYEIKPKKVFN

SEQ ID NO: 4928 - protein, 241 aa, Staphylococcus epidermidis
RGVKMSEMSAIYRVKQYILNLIKDGELTNGSKLPSNLSIARALNVKTDDVYDGIDELITEQVVTDNFEEGTSVKVKPPFYYPLNKIISIGTMIKEAGYEAGTEYLNLDEQPATILDAEHLGIETKEPITIIERLRTANHKPVVYCLDKIAKTYLTCTDYQQSSGSMLEAIKASTNHQIMHAEMDLEAISYEPHISEVLNASPHEGLMLLKVVHYDEKHQPILYSLNYIKSSLVKFTITKSE

SEQ ID NO: 4929 - protein, 289 aa, Staphylococcus epidermidis
GGKNVSSNELLLATEYLEKEKKIPREVLIDAIEAALITAYKKNYDSARNVRVELNMDEGSFRVIARKEVVEEVFDDRDEVDLSTALVKNPAYEVGDIYEQDVTPKDFGRVGAQAAKQAVMQRLRDAEREILYDEFIDKEEDILTGVIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVYSDNPDIDAVGACVGSKGARVEAVVEELGGEKIDIVQWDEDPESICS

SEQ ID NO: 4930 - protein, 866 aa, Staphylococcus epidermidis
MRRKACFIILLITLSLIGHSYIIFRFHHDGVLSTGPNDGMEQMIPIQMYLYHQWTQGNLFYSTHLGLGGDFFTDLSYYFSTNLIFILNVPIIKLCEIFFSLNTNQILLWMYNALIVSIIKSTIALFCTYLFSYYISKNKIISLLISFIFVMSPLYFRFTIYWPFFSDTFIWLPLLLLGIERLLRDFKAGLFILTVSLILINNFYFAYYFLIIGIGYTLIRIIYRHPKDSLTRWQASLTIICSALLALGNSMFVFFHGVQSFLNNRRQSFTGQVNWIEHLNKDTNIFFDNYLIVVIFLSIQALLTIKLYKHFYYKLFALLLLATIIFAFLPFVDQLFNGFSAPQKRWHFILAFNSSILIGLFVKYFKTIRPKTYIYTNLIAQSVIYISSISYNTFLPWLSLVPVVSVIGLLILLIKEKKVRYYLTYLYSISIAALSLMITFVFIKNQIFFQDHINRANKRYINSSFYNSAIQRSLVKEMNQTKNDDQRINWRVDEQDNTPMYQNFKGLSIYSSIFHHNILDFYYDALKINLAEESVSRYQSTNARQNIESLFSVKYLMMKDYQNFIPSYFKKVKSRGQYIIYKNQLPLPSVKVTQNIYNHKSLKKPIDREHAMINGAIVTSKGTAYHSKVKNLLDQTRVSTQNITRYSNNELTVNKESGIIKLHLPKNIRDKYKDFYLTMNIKRGDPDSNYTVSINQYHNHRLYNDSIYRTGISKVLYRSLPDKNGDITIQLSPKGKFNLELLELNGENYDTLKQAHHHANFNMRYKDIKNGVKVNLDHHSKGLAVINIPYRKGMRAYVDDRQSNIKKVNYMMTGVPVNKNDKTITIQYRPPFLKTMFSISIFSIVVSIVFIRLKNIRKRKMRIRHD

SEQ ID NO: 4931 - protein, 175 aa, Staphylococcus epidermidis
LRQKSGHKPALFYLPKKEACMSKITEQVEALIQPVLNDLNFELVDIEYVKEGKDHFLRISIDKEGGVDLNDCTIASEKISEVMDENDPIPEMYYLDVASPGAERPIKKETDFYNAINQPIFVSLYAPIEGDKEWLGVLKSVNDESINMEVKEKAKTKEIEIPRNKIAKARHAVMI

SEQ ID NO: 4932 - protein, 95 aa, Staphylococcus epidermidis
LRRKLIMAISQQRKDELIKEYRVHETDTGSPEVQIAVLTAEITALNEHLREHKKDHHSRRGLLKMVGRRRHLLNYLRSKDIQRYRELIKSLGIRR

SEQ ID NO: 4933 - protein, 573 aa, Staphylococcus epidermidis
IGRKKRMKQSKVFIPTMREVPAEAEALSHRLLLKAGLIKQSTSGIYSYLPLATRVLNNISKIIREEMESIDAVEILMPALQQAELWEESGRWSAYGPELMRLKDRNGREFALGPTHEEVVTSLVRDELKSYKQLPLTLFQIQSKYRDEKRPRFGLLRGREFLMKDAYSFHSDEASLDATYQDMYQAYSRIFKRVGINARPVVADSGAIGGSHTHEFMALSEIGEDTIVYSNESDYAANIEKAEVVYHPSHKHSALAELTKVETPNVKTAQEVAEYLKRPLDEIVKTMIFKIDGEFIMFLVRGHHELNEVKLKSYFGTEHVEMATPDEIVNLVDANPGSLGPIFDKDIKIYADNYLQDLNNFVVGANEDHYHYINVNIGRDFDVTEYGDFRFITQGEMLSDGSGVAQFAEGIEVGQVFKLGTKYSESMNATFLDNQGKAQPLIMGCYGIGVSRTLSAIVEQNNDENGIIWPKSVTPFDIHLITINPKKDDQRTLGDQLYQKLMDSYDVLYDDRKERAGVKFNDSDLIGLPVRVVVGKRAEEGIVEVKQRINGLSEEVQIDELEYYLQELFKNIK

SEQ ID NO: 4934 - protein, 326 aa, Staphylococcus epidermidis
TMGKIKELETSLANKIAAGEVVERPSSVVKELLENAIDAQATEINIEVEQSGVSSIRVVDNGTGIAQEDLGLVFHRHATSKIVADDDLFHIRTLGFRGEALASISSVAKVTLKTCTDNENGHEIYAEDGKIIHQKPAKAKKGTDIQVDSLFYNTPARLKYIKSLYTELGKITDIVNRMAMSHPEIRISLVSDGKKLLSTNGSGRTNEVMAEIYGMKVAKDLVHISGDTSDYHLEGFVAKPEHSRSNKHYISIFINGRYIKNFVLNKAILEGYHTLLTIGRFPICYINIQMDPILVDVNVHPTKLEVRLSKEDQLYDLIVTKIREGF

SEQ ID NO: 4935 - protein, 261 aa, Staphylococcus epidermidis
RVNDSMSLTIKEIKEKLSRIETLEELHKHEANNDSRKGVINAIKSREKNILKQQALEEHYLSMNQYENNIMSSNRDALICGIDEVGRGPLAGPVVACAVILEKNHHYIGLDDSKKVSPKNRARLNQNLKENVYQYAYGIASSVEIDELNIYRATQLAMLRAINQLDVTPTHLLIDAMTLDIDIPQTSIIKGDAKSVSIAAASIMAKEYRDQYMRQLSKQFPEYGFDKNAGYGTKQHLKAIDQVGIINEHRQSFEPIKSMMK

SEQ ID NO: 4936 - protein, 185 aa, Staphylococcus epidermidis
KMSDIIKDTKSRMQKSIDNLSRELANISAGRANSNLLNGVTVDYYGAPTPVQQLASINVPEARLLVISPYDKSSVADIEKAIIAANLGVNPTSDGEVIRISVPALTEERRKELVKEVKKIGEDAKVSIRNIRRDINDQLKKDEKNGDITEDDLRSQTDDVQKATDNSIKEIDQLVADKEKDIMSV

SEQ ID NO: 4937 - protein, 327 aa, Staphylococcus epidermidis
PKSERAFKDKILIPQNDLNHAPKKNKVLDTFEQQKINFVKQQSQIGETSAPYVHDHKDKNHDVESHKNNLDSTSSTNNESTEVSNELHNYIDDSYLQSQKEVFFDMEQNTSNEYEISNQQSNDIKGTVSQTPHRRVPYMEIVGQVHGTYIIAQNENGMFMIDQHAAQERIKYEYFREKIGEVTNEVQNLLIPLTFHFSKDEQMIIDQYKDELDKVGVHLEHFGGHDYIVNSYPVWFPKEEAEEIIKDMIELVLKHKSVDVKKIREDAAIMMSCKKSIKANHYLKNNEMADLIDQLREAEDPFTCPHGRPIIINFSNYELEKLFKRVM

SEQ ID NO: 4938 - protein, 690 aa, Staphylococcus epidermidis
TLADNLVIVESPAKAKTIEKYLGKRYKVIASMGHVRDLPRSQMGVDTEDNYEPKYITIRGKGPVVKDLKKHAKKAKKIFLASDPDREGEAIAWHLSKILELEDSKENRVVFNEITKDAVKDSFKHPRGIEMDLVDAQQARRILDRLVGYNISPVLWKKVKKGLSAGRVQSVALRLVIDRENEIRNFKPEEYWSIEGEFRYKKSKFTAKFLHYKNKPYKLNNKDDVQRITEALNGDQFEITNVNRKEKTRYPAHPFTTSTLQQEAARKLNFKARKTMMLAQQLYEGIDLKRQGTVGLITYMRTDSTRISTSAKSEAQQYINDKYGEQYVSQRKSSGKQGDQDAHEAIRPTSTMRTPDDMKAFLTRDQHRLYKLIWERFVASQMAPAILDTVALDVTQNDIKFRANGQTIKFKGFMTLYVEAKDDKENDKENKLPQLDKGDKVTATKIEPAQHFTQPPPRYTEARLVKTLEELKIGRPSTYAPTIDTIQKRNYVKLESKRFIPTELGEIVYEQVKEYFPEIIDVEFTVNMETLLDKIAEGDMNWRKVIGDFYNSFKQDVERAESEMEKIEIKDEPAGEDCEVCGSPMVIKMGRYGKFMACSNFPDCRNTKAIVKTIGVTCPKCNEGDVVERKSKKNRIFYGCSRYPECDFISWDKPVGRDCPKCHHYLVNKKKGKSSQVVCSNCDYEEEVQK

SEQ ID NO: 4939 - protein, 97 aa, Staphylococcus epidermidis
SMQDTLMSIQIIPKTPNNNDVIPYVDEAIKIIDDSGLHFRVGPLETTVQGEMSECLILIQKLNDRMVELECPSIISQVKFYHVPEGIEIETLTGKYD

SEQ ID NO: 4940 - protein, 94 aa, Staphylococcus epidermidis
VWKELSHYTRLKSKKLKLNVVVKYVVLNYITYVVYVVKLLEFKKFANQYIRQFIKGQSISTIVANFNLLLKICHNEKSFQTSVLPEFESFFILS

SEQ ID NO: 4941 - protein, 263 aa, Staphylococcus epidermidis
LKGDNRVFFTYIFTYFYDREDKKMAQTSKYKRVVLKLSGEALAGDKGFGINPIIIKSVAQQVAEVAKMDCEIAVIVGGGNIWRGKTGSDLGMDRGTADYMGMLATVMNALALQDSLEQLDCDTRVLTSIEMKQVAEPYIRRRAIRHLEKKRVVIFAAGIGNPYFSTDTTAALRAAEVEADVILMGKNNVDGVYSADPKVDANAIKYEHLTHIQMLQEGLQVMDSTASSFCMDNNIPLNVFSIMEEGNIKRAVMGEKIGTLITK

SEQ ID NO: 4942 - protein, 573 aa, Staphylococcus epidermidis
IVSLYMDGSLFIGGNILSLIKKKNKDIRIIPLGGVGEIAKNMYIVEVDDEMFMLDAGLMFPEDEMLGVDIVIPDIQYVIENKERLKGIFLTHGHEHAIGAVSYVLEQIDAPVYGSKLTIALVKEAMKARNIKKKVRYYTVNHDSIMRFKNVNVSFFNTTHSIPDSLGVCIHTSYGSIVYTGEFKFDQSLHGHYAPDLKRMAEIGDEGVFALISDSTEAEKPGYNTPENIIEHHMYDAFAKVKGRLIVSCYASNFVRIQQVLNIASQLNRKVSFLGRSLESSFNIARKMGYFDIPKDLLIPINEVENYPKNEVIIIATGMQGEPVEALSQMARKKHKIMNIEEGDSIFLAITASANMEVIIADTLNELVRAGAHIIPNNKKIHASSHGCMEELKMMLNIMKPEYFVPVQGEFKMQIAHAKLAAETGVAPEKIFLVEKGDVISYNGKDMILNEKVQSGNILIDGIGVGDVGNIVLRDRHLLAEDGIFIAVVTLDPKNRRIAAGPEIQSRGFVYVRESEELLKEAEEKVRKIVEEGLQEKRIEWSEIKQNMRDQISKLLFESTKRRPMIIPVISEI

SEQ ID NO: 4943 - protein, 273 aa, Staphylococcus epidermidis
RFKCIYFINIYRRRKIMSLLSKTRELNTLLQKHKGIAVDFKDVAQTISNVTVTNVFIVSRRGKILGSCLNELLKSERIKDMLEDRHIPREYTEELMNVKQTESNIDIDNELTVFPPENREVFLNSRTTIFPILGGGERLGTLVLGRVQDDFNENDLVLGEYAATVIGMEILREKHNEVEKEARDKAAITMAINSLSYSEKEAIEHIFEELGGTEGLLIASKVADRVGITRSVIVNALRKLESAGVIESRSLGMKGTFIKVKKDKFLDELEKNK

SEQ ID NO: 4944 - protein, 173 aa, Staphylococcus epidermidis
IIILEELSTMNIRKLTITAFLIAINVVLSSLIVIPLGPIKAAPVQHFVNVLCAVFVGPWYGLAQAFISSVLRISFGTGSAFAFPGSMIGVLLSSLFYMYRKHIFMASVGEVLGTGVIGSLMCIPLAWFLGLQDFFIKPLMLMFIVSSFIGALISYILLIILKRRGLLDRFNKN

SEQ ID NO: 4945 - protein, 104 aa, Staphylococcus epidermidis
LMVRTDLTSFRSGDTLRVHVRIVEGSRERIQVFEGVVIKRRGGGISETFTVRKISSGVGVERTFPLHTPKIEKIEVKRRGKVRRAKLYYLRSLRGKAARIQEIR

SEQ ID NO: 4946 - protein, 234 aa, Staphylococcus epidermidis
MKALVIGGSGTIGRAIVKRLLFEGYEVFLHYHSAQYSDLSNQFKNSKVTFIQCDLTKDIELEDYFGHIDELDCLIYTSGTALYGMLQDMSDCDIDNSYALNVRQFIRLTRYFIDILRQSNNGRIIVISSIWGETGASLETIYSAMKSAQIGFVKALSQELALTSVTVNAITPGMVKGKMSDVWSKDELSNIVSELPQQRMIDPSEVAHACAYLCSTMSKSITGTVHKVNGGWYI

SEQ ID NO: 4947 - protein, 97 aa, Staphylococcus epidermidis
TSKRRRINHEREVLKQQALNEGKPEKIVEKMVEGRLRKYLQEICAVDQNFVKNPDETVEAFLKAKGGKLTDFVRYEVGEGMEKREENFAEEVKGQMK

SEQ ID NO: 4948 - protein, 445 aa, Staphylococcus epidermidis
SCSRYNLCTNERRPTLMKTHQYELIDEKVFEHEFDNGLKLFIIPKPGFQKTYVTYTTQFGSLDNHFKPIGSQQFVKVPDGVAHFLEHKLFEKEDEDLFTAFAEENAQANAFTSFDRTSYLFSATSNIESNIKRLLNMVETPYFTEETVNKEKGIIAEEIKMYQEQPGYKLMFNTLRAMYSKHPIRVDIAGSVESIYEITKDDLYLCYETFYHPSNMVLFVVGDVSPQSIIKLVEKHENQRNKTYQPRIERAQIDEPREINQRFVSEKMKLQSPRLMLGFKNEPLDESATKFVQRDLEMTFFYELVFGEETEFYQQLLNKDLIDETFGYQFVLEPSYSFSIITSATQQPDLFKQLIMDELRKYKGNLKDQEAFDLLKKQFIGEFISSLNSPEYIANQYAKLYFEGVSVFDMLDIVENITLESVNETSELFLNFDQLVDSRLEMENR

SEQ ID NO: 4949 - protein, 105 aa, Staphylococcus epidermidis
LTDSYAFLISDFRGHFFCFCYLILRFIIFIILFIFIVFLILISFIVFILLFSFVVLFFFLRWFTIILTLLFFFIVRILFIIRFLVIILSILFISVFRLRGFKFFI

SEQ ID NO: 4950 - protein, 424 aa, Staphylococcus epidermidis
ILKRFNQDNTKVRVNVLPTDKFKTTTITFKFMAPLNYKTITSRSILSKVLVRATQQWPTDKTLNKQLSELYGAYVNSFVSKFKDKHVITISLEVVNEKFLKDKTPLFEKGLDTLKEIIWNPLIKDRCFDHTYVAQEKSLLSKKLEAMEDNKAQYSFLQLMNYMFKQEPYRYIATGQLEQIPQVTSESLYDTYLSMVQNDDCAIYVVGNINKEEVTQLILDKFAIKPFYLENKESTEITPSFDQPQYIIEKDDVDQAKLNLGYRFPSYYGKSNYYAFIVLNMMFGGDPSSVLFNEVREKQSLAYSIHSQIDGKNGFLFVLSGVSAEKYEQAKDTVIKEFDKIKNGDFDSNKIELAKKIIISHRHEASDRPKSIIEILHNQLLLNRQQTDQDFINAVNQVTKKDVIKLANEAVLDTIYVLTKGDQH

SEQ ID NO: 4951 - protein, 388 aa, Staphylococcus epidermidis
ISGSISLMNISIVAVGSELLLGQIANTNGQYLSKLFNSIGKSVVEHTVIGDNPQRLEYVIKQCLSRFDTIVLTGGLGPTKDDLTKHTVAKVLGKNLVTDEASLNFIKNYFKEQGQDMTSNNKQQALVIEDAIVLPNKNGMAPGMLVELGKQKIILLPGPPKEMQPMAKNELLPYLMDKDEVIFSELLRFAGIGESKLETLLIDLIDDQTNPTIAPLAGTHEVYFRLTANAESKERCQLLIKPIRDEILNRVGTYYFGSDEVNIEESVINSAKQNFAIYDGVTNGALFTRLKNADSKNLVKGMLPHSNQFIDVTSEFNAVLFNAAQYVRDLYQTDLGIVLLNKDNIVYLGIYDGNNFDIETFKMSQSRNLLRSRSQNYAMIRLLNWFNK

SEQ ID NO: 4952 - protein, 309 aa, Staphylococcus epidermidis
GKDGSTKMSVFIDKNTKVMVQGITGSTALFHTKQMLDYGTQIVAGVTPGKGGQVVEGVPVYNTVEEAKNETGANVSVVYVPAPFAADSIIEAADADLDMVICITEHIPVVDMVKVKRYLQGRKTRLVGPNCPGVITADECKIGIMPGYIHKKGHVGVVSRSGTLTYEAVHQLTEEGIGQTTAVGIGGDPVNGTNFIDVLKAFNEDSETKAVVMIGEIGGTAEEEAAQWIKENMNKPVVGFIGGQTAPPGKRMGHAGAIISGGKGTASEKIKTLNDCGVETADTPSEIGTTLIDAAKKAGIYEELLTIKK

SEQ ID NO: 4953 - protein, 474 aa, Staphylococcus epidermidis
QYGGMLNMDTNGIKLTPKDIVSKLNEYIVGQNDAKRKVAIALRNRYRRSLLKEEEKQEIAPKNILMIGPTGVGKTEIARRMAKIVGAPFIKVEATKFTEVGYVGRDVESMVRDLVDVAVRLVKDGKKSLVKDEATKKANDKLVKLLVPSLKKKAAQGNNPLENLFGGAIPNFGQNQDEEEEPPTEEIKTKRSEIKKQLEQGKLENEKVRIKVEQDPASMGMLGTNQNQQIQDMMNQLMPKKKVEREVSVETARKILADDFADELIDQETANQQALELAEQMGIIFIDEIDKVATNNQNSGQDVSRQGVQRDILPILEGSMIQTKYGTVNTEHMLFIGAGAFHVSKPSDLIPELQGRFPIRVELESLSVEDFVRILTEPKLSLVKQYEALLQTEEVTVNFSEDAIQRLAEIAYQVNQDTDNIGARRLHTILEKMLEDLSFEAPSMPNAVVDITPQYVDDKLKSISTNKDLSAFIL

SEQ ID NO: 4954 - protein, 394 aa, Staphylococcus epidermidis
ETGGWKMNIHEYQGKEIFRSMGVAVPEGRVAFTAEEAVEKAKELNSDVYVVKAQIHAGGRGKAGGVKIAKSLSEVETYANELLGKQLVTHQTGPEGKEVKRLYIEEGCDIQKEYYVGFVIDRATDKVTLMASEEGGTEIEEVAAQTPEKIFKETIDPVVGLSPYQARRIAFNINIPKESVGKATKFLLALYNVFIEKDCSIVEINPLVTTGDGQVLALDAKLNFDDNALFKHKDILELRDLEEEDPKEIEASKYDLSYIALDGDIGCMVNGAGLAMATMDTINHFGGNPANFLDVGGGATKEKVTEAFKIILGDDNVKGIFVNIFGGIMKCDVIAEGIVAAVKEVELTLPLVVRLEGTNVERGKAILNESGLAIEPAATMAEGAQKIVKLVKEA

SEQ ID NO: 4955 - protein, 1362 aa, Staphylococcus epidermidis
QLIFQLKIPTIKMSFALKYFGHCIDQTRLSPKVKGQLKQKKLIMSGNVLKVLVSNDIERNHFDRACNGSLVKAFRQCGFEIDKVVFETDSTNHDDDLGSLEAHIPQEDEQSAREATEKLEKMKAEKAKQQDNNESTVEKCQIGKPIQIENIKPIESIIEEEFKVAIEGVIFDINLKELKSGRHIVELKVTDYTDSLVLKMFTRKNKDDLDHFKALSVGKWVRAQGRIEEDTFVRDLVMMMSDIEEIKKTPKQDKAEDKRVEFHLHTSMSQMDGIPNISAYVEQAAKWGHQALAVTDHNVVQAFPDAHNAAEKHGIKMIYGMEGMLVDDGVPIAYKPTDRNLKDATYVVFDVETTGLSNQYDKIIELAAVKVHNGEIIDKFERFSNPHERLSETIINLTHITDDMLTDAPEIEEVLTEFKEWVGDAIFVAHNASFDMGFIDTGYERLGFGPSTNGVIDTLELSRTINTEYGKHGLNFLAKKYGVELTQHHRAIYDTEATAYIFIKMVQQMKELGVNNHLEINKKLTNEDAYKRARPSHVTLIVQNQEGLKNLFKIVSASLVKYYYRTPRIPRSLLNEYREGILIGTACDEGELFTAVMQKDQSEVEKIAKFYDFIEVQPPALYQDLMDRELIRDNETLTQIYKRLIDAGKSANIPVIATGNAHYLYEHDAIARKILIASQPGNPLNRSTLPEAHFRTTDEMLDDFHFLGEEKAYEIVVTNTNELANKIEKVVPIKDKLFTPRMDGANEEIRELSYSNAKKLYGEDLPQIVIDRLEKELDSIIGNGFSVIYLISQRLVKKSLDDGYLVGSRGSVGSSFVATMTEITEVNPLPPHYICSHCKTSEFFDDGSVGSGFDLPDKKCPTCGNELIKEGQDIPFETFLGFKGDKVPDIDLNFSGEYQPNAHNYTKVLFGEDKVFRAGTIGTVAEKTAFGFVKGYLNDQGIHKRGAEIDRLVKGCTGVKRTTGQHPGGIIVVPDYMDIYDFTPIQFPADDQSAAWMTTHFDFHSIHDNVLKLDILGHDDPTMIRMLQDLSGIDPKTIPVDDKETMQIFSGPESLGVTEDEILCKTGTFGVPEFGTGFVRQMLEDTKPTTFSELVQISGLSHGTDVWLGNAQELIRQGICDLSSVIGCRDDIMVYLMYAGLEPSMAFKTMEFVRKGRGLTDEMVEAMKENNVPDWYLDSCRKIKYMFPKAHAAAYVLMAVRIAYFKVHHPLYYYAAYFTIRASDFDLITMIKDKTSIRNTVKDMYSRYMDLGKKEKDVLTVLEIMNEMAHRGFRLQPISLEKSQAFDFIIEGDTLIPPFISVPGLGENVAQRIVEAREEGPFLSKEDLNKKAGLSQKVIDYLDELGSLPDLPDKAQLSIFDM

SEQ ID NO: 4956 - protein, 196 aa, Staphylococcus epidermidis
GFNMNIPNQITVFRVILIPFFILFALVDFGFGQISILGGNHIRIEILISAIIFVVASLSDFADGYLARKWQLVTNMGKFLDPLADKLLVASALIVMVQLGFTNSVVAIIIIAREFAVTGLRLLQIEQGFVSAAGQLGKIKTAVTMVAIIWILLGDPFLHYLHFPIGVWLLYIGVFFTILSGIEYFYKGRDVFKHSK

SEQ ID NO: 4957 - protein, 124 aa, Staphylococcus epidermidis
HNNMYSEKEIIRKVESLAEKIGKLEVVQDYHNVEKQIHNNQAIKQKMNRLKAQQKQSVNFQNYGKQNALEQSEVKIQNLKDEINELPIVEEFRSAQYEANDLLQMMVKTMEDRLNEYNKKEHNE

SEQ ID NO: 4958 - protein, 104 aa, Staphylococcus epidermidis
HRIIGWSDKLMRKKKIPMRKCIISNEMRPKKDMIRVVINKEGEIFADATGKKQGRGAYVSKDVALVEKAQQREVLEKYFNATKDTLDPVYKEIIRLIYREEIPK

SEQ ID NO: 4959 - protein, 870 aa, Staphylococcus epidermidis
GFAMIKNIWNKPIKRFTLIVLVSCILSFILYGPFLYQFITKGIVFSGSGDGFRQMMPFQMYLYEHFTSLKGFYDASFGLGGDYVKSLAYYYSLSPLMWINFSMIWILEQTINVNPHDISFWPINQLIMAYVRTVITFIFSFYLFSYLRLKPAPMFIATILYGMSTVVTYYNFTWSFYGNLLIMLPMSLWAIERFFKERKIGWFIFAIAYTLFSNFYFSYYEAIVIGFYFIYRFAIPHEKDIVNRWQKLYILVCATLLSVLVSIYGLYTGISSFLDNDRAQNPNFKITFFTNLFETNYNIFADGFYITISFIAIIALFCFKLYQHYYYKLFAIATWILLIGSFSQWFDSAFNGFSLPQRRWVYFLALSTSVLIALFIQHLSEISIKEYTFVAIPVFIYGFIFIALSERSVKWMFVALILIIVLFIFIKYKSLLTRTSMMVLLVVLFLAQQVLMTNDSRKITIEPYQTTIKTINDSSYRSPVLNKKIKYMHQSSTDPLKRLDYFSYYALNSPLIYHYNGTSLYSSIFDGDILKYYDQTLQINMPVDKNSTYRYLNNRANLMSLWDVQDRLRHPDDLNMPYGFKKKELITDKKDQWIHSVNTINYPSAHITNKIYDARKLKSPLDREQAMLKGVVLNHKSQANTDFKPNPNLLSNAKQNLNHANWIDSKHLKVKQHNGGVTLNLLRNIVKNYKDMYIEMDVELLSLDKEHKVGVNEYSQERNRLSYKYRRFVSPVTMRAKASNQLNIKMSKGVYRFKVKGIYGENYQTLKKASQQLQPVKVKKERNGFTIIKKKKEHGYLVLPMVYAKGMHAMANGKPLKVQQGNGIMTTIPVKEGQTKIKLSYTPPYFYLLITVSCIGIILSILFTHYVKRK

SEQ ID NO: 4960 - protein, 429 aa, Staphylococcus epidermidis
NMSILITIISFIIVFGVLVTVHEYGHMFFAKRAGIMCPEFAIGMGPKIFSFRKDETLYTIRLLPVGGYVRMAGDGLEEPPVQPGMNVKIKLNNQDEITHIILDDQHKFQQIEAIEVKKCDFKDDLYIEGITSYDDERHHFTIAKKAFFVENGSLVQIAPRDRQFTHKKPLPKFLTLFAGPLFNFILALVLFIGLAYYQGTPTNVIGEVVKKSPADEAGLHKGDKIVQVGNHKIKNFDDIKHVLDQNKTAKTTVKIKRDGQNKSVDLQPKKVERKITKTKTQTTYQIGFAPTTEHSVFKPISYGIYNFFDKGKLIFTAVVGMLASIFTGEFSFDMLNGPVGIYHSVDSVVKSGIINLVGYTALLSVNLGIMNLLPIPALDGGRILFVLYEAIFRKPVNKKAETGIIAVGALFVVIIMILVTWNDIQRYFL

SEQ ID NO: 4961 - protein, 130 aa, Staphylococcus epidermidis
VKTIGEVLKSRRERLGMTLSELEQRTQLKRQTLIHIENNDFNELAKSDYTEGFIRKYAKVVNIEPNQLIEAHQDEIPETQYQIDDVIQTFSNGYEPPYRRQSKEAFQLLMWMGFIILISLIVWILAVLII

SEQ ID NO: 4962 - protein, 266 aa, Staphylococcus epidermidis
TETIRLGGKTMFKKLKNKNKTETNHNNDLDIHNIPEHVAIIMDGNGRWAKKRKMPRIKGHYEGMQTIKKITREASDIGIKYLTLYAFSTENWSRPESEVNYIMNLPVNFLKTFLPELIEKNVKIETIGFYEGLPQSTIDAIDFAKAKTQHNTGLTLVFAINYGGRAEIIQSMKAIYNELQLNGQGSEVIDEALIKRHLMTHSYPDPDLLIRTSGEQRISNFLIWQASYSEFIFNEKLWPDFDEKELRECLKIYQSRQRRFGGLSEE

SEQ ID NO: 4963 - protein, 288 aa, Staphylococcus epidermidis
LMAIQWYPGHMAKAKRQVSEQLKKVDVVFELVDARIPYSSRNPMIDDVIKQKPRVVILNKKDMTNLKELEKWEIYFKNEGFYPVAVDAKHGKNLKNVEVEAIKATQEKFDREKAKGLKPRAIRAMIVGIPNVGKSTLINKLAKRSIAETGNKPGVTKQQQWIKVGKSLQLLDTPGILWPKFEDEEVGKKLSLTGAIKDSIVHLDEVAIYGLNFMIKHDVSALKRHYNIDTHEDAEILDWFDAIGRRKGLLQKGNEVDYESVIELIINDMRNAKIGTYCFDILKEMKSE

SEQ ID NO: 4964 - protein, 115 aa, Staphylococcus epidermidis
CLIVLNLVLIKVVIILAMTNREKFKVLADQIKISNQLEQDILEQGELTRIDVSNKNRTWTFQISLPHFLSHEDYLLFTHAIEEEFKEIATVAIDFSIKDTNNQDEFRFKIFRTLY

SEQ ID NO: 4965 - protein, 357 aa, Staphylococcus epidermidis
LSVVGGLVLDNERQKALDTVIKNMEKSFGKGAVMKLGDNKGRRVSSTSSGSVTVDNALGVGGYPKGRIIEIYGPESSGKTTVALHAIAEVQKNGGVAAFIDAEHALDPVYAQALGVDIDNLYLSQPDHGEQGLEIAEAFVRSGAVDIVVVDSVAALTPKAEIEGEMGDTHVGLQARLMSQALRKLSGAISKSNTTAIFINQIREKVGVMFGNPETTPGGRALKFYSSVRLEVRRAEQLKQGQDIVGNRTKIKVVKNKVAPPFRVAEVDIMYGQGISKEGELIDLGVENDIVDKSGAWYSYNGDRMGQGKENVKNYLKENPQIKEEIDRKLREKLGIFDGDVDENENEDDSPKTLFDE

SEQ ID NO: 4966 - protein, 261 aa, Staphylococcus epidermidis
KMKVRTLTAIIALLIFLPILLKGGLILMLFAFLLALIALKELLNMNMIKFLSIPGLISALALIIIMLPQDAGEWVQVIQLKGLIAMSFIVLSYTVLSKNRFSFMDAAFCLMSVAYVGIGFMYFYETRSEGLRYILFAFLIVWLTDTGAYIFGRLMGKHKLWPVISPNKTIEGFFGGILCSILVPLVMQMFVDLHMNIWLLLLVTIVLSMFGQLGDLVESGFKRHFGVKDSGRILPGHGGILDRFDSFMFVLPLLNILLIQT

SEQ ID NO: 4967 - protein, 183 aa, Staphylococcus epidermidis
CRGVLIMKENILPAIRNMRDLEKLIKTDYKACVVLDMHIGHLKSIMELLKSHSIECYVHIDLIKGLSHDEFACEYIIQQYKPKGIVSTKAKVIKKAKMLNTLTIFRVFIIDSQALTRSIELIKKVEPDYVEVLPGVASKAVSKIQQETSASVIAGGLIDEQSEIREAISNGAKYVTTSYEKLW

SEQ ID NO: 4968 - protein, 728 aa, Staphylococcus epidermidis
MNMVRSDYMSKKRIYEYAKELNLKSKEIIDELKSMNVEVSNHMQALEEEQIKALDKKFKASQAKDTNKQNTQNNHQKSNNKQNSNDKEKQQSKNNSKPTKKKEQNNKGKQQNKNNKTNKNQKNNKNKKNNKNNKPQNEVAETKEMPSKITYQEGITVGELAEKLNVESAGIIKKLFLLGIMANINQSLDEETLELIADDYGVEIEKEVVVDEEDLSIYFDDETDDSDAIERPAVVTIMGHVDHGKTTLLDSIRNTKVTEGEAGGITQHIGAYQIENSGKKITFLDTPGHAAFTTMRARGAQVTDITILVVAADDGVMPQTIEAINHAKEAEVPTIVAVNKIDKPTANPDRVMQELTEYGLIPEDWGGDTIFVPLSALSGDGIDDLLEMIGLVAEVQELKANPNKQAVGTVIEAELDKSRGPAASLLVQNGTLNVGDAIVVGNTYGRIRAMVNDLGKRIKSAGPSTPVEITGINDVPLAGDRFVVFGDEKQARRIGEARHEASVIQQRQESKNVSLDNLFEQMKQGEMKDLNVIIKGDVQGSVEALAASLMKIDVEGVNVRIIHTAVGAINESDVTLANASNGIIIGFNVRPDAGAKRAAEAENVDMRLHRVIYNVIEEIESAMKGLLDPEFEEQVIGQAEVRQTFKVSKVGTIAGSYVTEGKITRNAGVRVIRDGIVLFEGELDTLKRFKDDAKEVAQGYECGITIEKYNDLKEGDIIEAFEMVEIQR

SEQ ID NO: 4969 - protein, 288 aa, Staphylococcus epidermidis
LATFKDFRNNVKPNWCPGCGDFSVQAAIQKATANIGLEPEDVAIITGIGCSGRLSGYINSYGVHSIHGRALPLAQGVKMANKDLTVIASGGDGDGYAIGMGHTIHALRRNMNMTYIVMDNQIYGLTKGQTSPSSAKGFVTKSTPKGNIEKNVAPLELALSSGATFVAQGFSSDIKALTKMIEDAIHHDGFSFVNVFSPCVTYNKVNTYDWFKEHLTSIDDIEGYDITDKQLAMKTVLDHESLVKGIVYQDTTTPSYESQISELEHEALAKRDIHITEETFNDLTAQFL

SEQ ID NO: 4970 - protein, 212 aa, Staphylococcus epidermidis
DDFSEVNMDKFKSMTELKELTKEGKDWEIECENRSSIVTILALHGGGIEPATTELAYTIAHCGDYNYFSFKGMRSKGNNELHVTSTHYDDQIALDLVRGSQRTVAIHGCEGNESVAYIGGSDDRLIELITESLEDIGISVREAPHHISGTQENNIVNMTQTQGGVQLELTAQLRKELFKNRKSSRKNRENKDNWDDLMYDFADAMKKAIERA

SEQ ID NO: 4971 - protein, 208 aa, Staphylococcus epidermidis
MAISAKLVKELREKTGAGMMDCKKALTETDGDIDKAIDYLREKGIAKAAKKADRIAAEGLVHVEVKDNEAAIVEINSETDFVARNEGFQELVKEIANHILHSKVETVDALMESKLSSGKTVDERMKEAISTIGEKLSIRRFSIRTKTDNDAFGAYLHMGGRIGVLTVMEGTTDEEAAKDVAMHIAAINPKYVSSEQVSEEESIMKEKY

SEQ ID NO: 4972 - protein, 290 aa, Staphylococcus epidermidis
TKISCASLLTRGDQEMTFAKRKEWYLEYEITVNRAGLLGDISSLLGMLGISIVTINGVDQGKRGLLIKTDQLEKVERFEQIVKEINEIEITKLRVPELRDRLAVRHGRYIEQDADDKKTFKFEREDLGLLVDFLAELFKEEGHKLIGIRGMPRVGKTESIVAGSVCAHKRWLFISSTLIKQTVRRSLFKGEYDSNHVYIIDGAVTARELNPEHQELVREVMTLPSIKVVEHPDLFVESCNYNMEDFDYIIELRENEDQEIRYEEMKKHTVQSKNNLDFGDPFGGGFGFFE

SEQ ID NO: 4973 - protein, 113 aa, Staphylococcus epidermidis
SVRSCEINSICRSSLEHPTKRVLAPCCGKCRAFYFQNDVVIAKTSMTTIQLQPKQVINMMTQLQDASIIFKQTDCLHNAAISDVKDFLNITTISYVITLLINYTVIIFNDIYR

SEQ ID NO: 4974 - protein, 70 aa, Staphylococcus epidermidis
CKRFFEHHHDIVRHNTLDKLYGYYIQRHIPVRDKILIFSGRISLEILIKAAKIDVGIIFSKSSLLHFNTT

SEQ ID NO: 4975 - protein, 413 aa, Staphylococcus epidermidis
VKFLASQLFKGGFFIDYLGVDISKRSSVVAHYKNGKFQKEFFIQNNKNGYNYLLKYLNDLDHPQLIFESTGIYSRGMERFCCVNQINYIQMNPLEAKFKTSTLRSWKTDQADAHKLACLGPTLKQTDNLPIHELIFFELRERVRFHLEIENEQNRLKFQILELFHQTFPGLERLFSSRYSIIALNIAEIFTHPDMVLDIDKEVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 4976 - protein, 93 aa, Staphylococcus epidermidis
LVMLLNIIEGVTHINPKVLKALAITSNVLLVIGIICLIMLKLMLAIAFFVVSLTISLVIFNVMFRHRTGMKIAINVSFFIVMIAIVIAYFVLS

SEQ ID NO: 4977 - protein, 65 aa, Staphylococcus epidermidis
FPSPLAELVNKYSYSLIPNKLSSTALFQLRKYKNNPLTIAVKGLLHYYIIFYSHSIVLGGLEVMS

SEQ ID NO: 4978 - protein, 165 aa, Staphylococcus epidermidis
LHPPELISIQIIKIAPIYSCVRIDWIFYLIVMFVRGHCLEVTNLRKWFYYFNRRNKRMQWLKVILAGFIEIIWVTGLDQAHSLFTWIFTLFFIALSFFLVIDASKHLPVGTVYAFFVGIGAVGTVLVDMIFFNQPFTFTKIFLIMTLILGIIGLKLTTDATKEGR

SEQ ID NO: 4979 - protein, 192 aa, Staphylococcus epidermidis
VESLGRKVKEDGVVIDEKILKVDGFLNHQIDAKLMNDVGKTFYESFKDAGITKILTIEASGIAPAIMASFHFDVPCLFAKKAKPSTLKDGFYSTDIHSFTKNKTSTVIVSEEFLGADDKVLIIDDFLANGDASLGLNDIVKQANATTVGVGIVVEKSFQNGRQRLEDAGLYVSSLCKVASLKGNKVTLLGEA

SEQ ID NO: 4980 - protein, 136 aa, Staphylococcus epidermidis
AIEFYHTNTTSKNQLRRHIIMSNKVQRFIESERELSQLKHWLKTTYRISIEEFVVLYKVYADTKISGKELRDTLHFEMLWDTSKIDVIIRKIYKKELISKLRSETDERQVYYFFDAKQKKLLDKMTGEIETISIAN

SEQ ID NO: 4981 - protein, 92 aa, Staphylococcus epidermidis
PSHTFYLPSFVASVVSFNPIIPKIRVIIKNILVKVNGWLKKIISTNTVPTAPIPTKNAYTVPTGKCFEASMTRKKLKAIKKRVNIHVNNECA

SEQ ID NO: 4982 - protein, 145 aa, Staphylococcus epidermidis
QSITQSFKEAISMIPGEIIVKNTEIEVNKHHPETVIEVKNTGDRPIQVGSHFHFFEANKALEFDREKAYGKHLDIPAGAAVRFEPGDEKKVQLVEYSGRRKIYGFRGLVDGDIDEERVFRPNDSNQNAAVKNDAGEDNANKKGGK

SEQ ID NO: 4983 - protein, 62 aa, Staphylococcus epidermidis
TKLTRCLMYRDYNKTQLTLPMETSVLIPTNDITRYVHNIVETILETEFRHHRDSTSYHPKMM

SEQ ID NO: 4984 - protein, 221 aa, Staphylococcus epidermidis
YSPTRRYNCAHSTGQWGLIKMKAIILAGGESSRFGKAKAFAKIDNQYFYQKIIETLKSTNMFNRIIISTNSQLASQFEYEYVIIDDEHHQNKGPLTGIYSVMKQYMDEELFFIVSVDTPMITSKAVNGLYHFMVSNLIESRLDIVAFKEGEICIPTIGFYTLSTFPFIEKALNSNHLSLKHVIKQLSTDWLDVTEIDSPHYWYKNINFQHDLDSLKKQINE

SEQ ID NO: 4985 - protein, 147 aa, Staphylococcus epidermidis
PCKTTFLKGAIIMAKITVVNNQDELYKVINQIKSEGYLETELAVISKSKLHLDDLHNSQISLMATSGSFSDRMSRLLTGEDGEETVLSRYDLTDNELEGYKQDILNDKMLVVANSDRSSHDEVEDNNAAYKEVDITHYAAESEGPKA

SEQ ID NO: 4986 - protein, 87 aa, Staphylococcus epidermidis
RGFYMRKFILLLFIILNLVAIIITINHPLTISYFSLRVIFVAFIFIISIFFIFLRTTNYELILSILSTVFAFIHIGLIIHSAYLYLY

SEQ ID NO: 4987 - protein, 122 aa, Staphylococcus epidermidis
RSAHMNKALVIRAIKFSLIFMTAFLILNLLTMKEASISSIIVRTVIAAIVFFVIYIIVFTILSSSERKIIYGTTLPIALFICLIFGAIFFTPRIGIIAGLIIGVFAGVIWEFLNRKNGGRSS

SEQ ID NO: 4988 - protein, 69 aa, Staphylococcus epidermidis
CGYHKIKSLLIKRLIDSKPNKKIMRNYSWEYFNAQIKKSFQNQNKTIYSQSKIDVEPDFGFSLVCPFEG

SEQ ID NO: 4989 - protein, 119 aa, Staphylococcus epidermidis
LFNHMGGFMNYLEISLHIEQQLVKLLSLSENAKYYALIHHNKFESFIDDFNLTVNQEMKWAMSHQLLLNSNDTLLSYCQLIRRLNDSPLLTLNQGHIIYYINTQQTLIHRQLLKHKQAL

SEQ ID NO: 4990 - protein, 296 aa, Staphylococcus epidermidis
QMNHLTTETRNIQTMHLDEMNLSDALKTMNQEDQLVPKAIEPVIPNLTKVIESAIQRFNNGGRIIYIGAGTSGRLGVLDAAECVPTFNVSPNDIIGIIAGGQKAMTVAIEGAEDDAEQGAQDLKNIHLQSKDIVVGISASGRTPYVKGALVYANKMNAETVALSCNVHSDISKNSNHVLEINVGPEVLTGSTRLKSGTAQKLVLNMISTMTMIGVGKVYDNLMVDLRPTNQKLIHRSIRIIQDVCDLNHQEAIELYEKSDHNIKIAIVMHLCSTTQQDARLRLKQNNGVIKQAINT

SEQ ID NO: 4991 - protein, 213 aa, Staphylococcus epidermidis
RWGQVMENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLRLILFGIGNGGNPIGISNLWSHGGFMPNGFIGFFFALSIVI

SEQ ID NO: 4992 - protein, 288 aa, Staphylococcus epidermidis
ARRLTERVNLMAEQRWTGQLDLTVFNNGQSSKARNIFFEKALKVLRPIYLEQSPVPTFYIVNVGGGYLDGDRYRVNVNLEDNAQVTLTSQGATKIYKTPNDHVEQYQTFNLSNQSYMEFVADPIIAYENAKFFQHNTFNLKEDSAMFYTDILTPGYSSNGQDFTYNYMHLINEIYIDNQLVVFDNMMLSPDKSRLDGIGYMENYTHLGSAYFIHPDVNQSFIEDIYTAVADFQKQYDCRIGITQLPTHGLAVRILTKRTQIIEEILTRVQSYINQTIYHRQINFLRKY

SEQ ID NO: 4993 - protein, 128 aa, Staphylococcus epidermidis
TLLQQDVHQRSGFIMGKIKDINDLVNATFQVKKFFRDTKKQYNLNYEEIYILNHILKSESNEISSKEIATCSEFKPYYLTKALQKLKDLNLLSKKRSVHDERTVIVFVSDEQREKIKKLILELENYIK

SEQ ID NO: 4994 - protein, 178 aa, Staphylococcus epidermidis
INMHKHQHQNIHLNRPIHVAILTVSDTRDYDSDKGGQLIQSLINQHENHVDINHYRIVKDDIEAITHQLKLWLTSSNQLDVIITTGGTGISQRDVTIEAVRPLLTKELEGFGELFRYLSYTEDVGTRALLTRAIAGTCDSTLIFALPGSTGAIKLAIEKLIKPELSHLVFELNKDIRY

SEQ ID NO: 4995 - protein, 102 aa, Staphylococcus epidermidis
ITPKPPCRAIAIAIFDSVTVSIPAEITGMFNLILSDNLTLKSTSLGKTSDAAGMSNTSSNVKDSLANLFSHIKNSLQFYLYLVTLFHIFFSLFILYTIKKEI

SEQ ID NO: 4996 - protein, 324 aa, Staphylococcus epidermidis
VIHKKTLGVSTMTKVYFNHDGGVDDLVSLFLLLQMENIELVGVSTIGADCYLEPSLSASLKIINRFSDVEINVAPSYERGKNPFPKEWRMHAFFMDALPVLNESCIPKRCKASEDEAYIDIIRKVKSCDEKVTLLFTGPLTDLAKAIKYDNSILKNIEKLVWMGGTFLDKGNVEEPEHDGTAEWNAFWDPEAVKVVLDSDMIVDIVALESTNQVPLTMEVRQMWADKRQYLGVDFLGTSYAAVPPLTHFVTNSTYFLWDVLTTAYVGSPNLVESTKLKIDVVSQGPSQGRTFQSENGREVQVITDVNKQAFFKYITDLAKKIET

SEQ ID NO: 4997 - protein, 368 aa, Staphylococcus epidermidis
YKHKNLVKRGKKMKIAIVGSGNGAVTAAVDMVDKGHDVRLYCRNESISKFDVALEKGGFDFYNEGEEKFIEFTDISDDMEYVLDGADIVQVIIPSSFIEYYAKVMSKFVTNDHLIFFNIAASMGSIRFMNVLEDRHIDVHPHFAEANTLTYGTRVDFNNAKVDLSLNVRRVFFSTFDRSELNESYEKVSKIYDYLVKEESLLKTNLENGNPEVHPGPTLLNVGRIDYSEEFSLYKEGITKHTVRLLHAIEIERLNLGRKLGFELSTAKESRIQRGYLERKDEDEPLNRLFNTSPVFSQIPGPNHVENRYLTEDIAYGLVLWSSLGRVIDVPTPNIDAVIMIASTILERDFFEEGLTIEELGLDKLGLE

SEQ ID NO: 4998 - protein, 263 aa, Staphylococcus epidermidis
LINNNEVDEAMFMSKITFKDIYIDGNKITEDTRKVIYLLPSQPLKYASNTWIYKTMPTMNQWLKDIEVQKKMHLNQSSYHLSFSFPANEKIDEVLLEKIRELGFQIGVLELYVIEAKALKELSRKRDVDIQLVSSNNINDYLHVYDVFARPFGDSYANMVKQHIYSSYNLDDIERLVAYVNQQPVGIVDTIMTDKTIEIDGFGVLEEFQHQGIGSEIQAYVGHMANERPVILVADGEDTAKDMYLRQGYVYQGFKYHILKENI

SEQ ID NO: 4999 - protein, 405 aa, Staphylococcus epidermidis
SNDKGGAVMNQSTIIKDPIFTKSFNINFAINFFVYLCMYLLIVVIASYSKSEYHASDSVAGLVVGLFIVGSLIGRFVTGKYVNRFGPKKILIFGLICLVVTQLLYFIPGSVWFLMMVRLLNGLATAVATTATGTIAAYITPPTRKSEGISLFSLSLVLGTAIGPFFGMLLMNSFSINILFTICVILGVISGLLSLLIKINFTTVKENTITHKRFNLAHFVAKEAIPVAFVMLLIGVTYAAILTYLQAFAVERDLVTSASYFFIFYAIASLITRPIAGRLMDDKNENVVVYPAFIFLVLSFVLLMLSFNGWVLLIAGIALGIGYGNLSSCMQAIAIKVSPSNKYGLATSTYFIGLDIGIGFGPSLLGLFTHMISYSQLYGIMGILGFATLVIYIFVHGRKVYSTSY

SEQ ID NO: 5000 - protein, 190 aa, Staphylococcus epidermidis
NLCKEDEQVTTKHLVYTALMTAIICILGLVPSVPLPFMPVPIVLQNIGIFLAGIILGRKLGTTSVIVFLLLVATGLPVLSGGRGGIGVFAGPSAGFLFLYPVVAYFIGIIRDAYLHKINFLVIFIATLVIGVLGLDILGTLIMGFIIHIPISKAFILSFTFMPGDIIKAIIASLIGAAILNHSRFKTLIQ

SEQ ID NO: 5001 - protein, 551 aa, Staphylococcus epidermidis
IKSNKDKHILVIIIKGSGRYSKMNAIKRFGSAMIVPVLMFAFFGIVLGFATLFKNPTIMGGLADQQTFWFKFWSVIESGGWVIFTHMEIVFVVGLPLSLAKKAPGHAALAALMGYLMFNTFINAILTQWPHTFGANLKKGVENTTGLKSIAGIETLDTNILGAIIISGIITWIHNRYYSKRLPEMLGVFQGLTFVVTISFFVMLPVAAITCVVWPTIQHGIASIQYFIVASGYIGVWLYHFLERVLIPTGLHHFIYAPIEVGPVVVNHGLKAEWLQHLNQFAESNKPLKEQFPYGFMLQGNGKVFGCLGIALAMYATTPKENRKKVAALLIPATLTAVVAGITEPLEFTFLFIAPFLFVLHALLAATMDTLMYGFGVVGNMGGGVLDFIATNWIPLGKAHWMTYVFQVVIGLIFVAIYYFLFKYLILKFDIPLPGRKKGEEEVKLFSKQDYKDKKGDSTRNHSPNSEYEEKAMYYLEGLGGKENIKDVTNCTTRLRLTVKDESKVQESAYFTHNQMSHGLVKSGKSVQVVVGMSVPQVREAFENIVNDDLS

SEQ ID NO: 5002 - protein, 73 aa, Staphylococcus epidermidis
KLLKPYSLDYMSHINYFMIIANFCCIFNIIKEMFTIQKASKFSVSVILKDELSLKCFNTKLYNYLCNSFIKLD

SEQ ID NO: 5003 - protein, 244 aa, Staphylococcus epidermidis
NPIKLNKFLKNINFLYKEFRAMPDLTSFWISFRVALISTMIVTIFGILISKWLYNKNRYWVNLLESFIILPIVLPPTVLGFILLIIFSTRSPVGEFFTNILHLPVVFTLTGAVIASVIVSFPLMYQHTVNGFRSIDSKMLNTARTMGASETKIFFKLVLPLSKRSILAGIMMSFARAIGEFGATLMVAGYIPDKTNTLPLEIYFLVEQGKENEAWLWVLVLVAFAVTVIATINLVNRDTFREVD

SEQ ID NO: 5004 - protein, 344 aa, Staphylococcus epidermidis
GGPKMKALIQDKLGRPIRDLRISVTDRCNFRCDYCMPKEIFGDDYTFLPKNELLTFEELTRISKIYAQLGVKKIRITGGEPLLRRNLYKLVEQLNLIDGIEDIGLTTNGLLLKKHGKNLYQAGLRRINVSLDAIEDNVFQEINNRNIKASTILEQIDYAISIGFEVKVNVVIQKGVNDNQIIPMIDYFKNKNIEVRFIEFMDVGNDNGWNFNKVVTKEEMLNMIEQHFEISPVTPKYYGEVAKYFRHKDNDAQFGLITSVSESFCSTCTRARLSSDGKFYGCLFASSEGFDVKALIRSGATDDDLKAQFKRLWSIRNDQYSDNRTMQTIENNRKKKINMNYIGG

SEQ ID NO: 5005 - protein, 1051 aa, Staphylococcus epidermidis
MIKKLLQFSLGNKFAIFLMVVLIILGGVYSSAKLKLELLPDVENPVISVQTTMSGATPQSTQDEISSKIDNQVRSLAYVNSVQTESIPNASIVTVEYDNGTDMDKAEEQLKKEIDKIKFKDGVGEPELTRNSMDAFPIVAYSFTSNNQKLKDVTKKLNQQLVPKLQTIDGVQNAQLNGQTNREVSLKFKQKNLDEKGLTANDVENYIKTATRETPLGLFQFNKSNKSIVVDGQFKSVDAFKNLKIPLSISGQAAQNDSDSDSDSLMPSDNTRSTNSSTHMAQKGQMPSVPLKDLADISVGDERTSISKTNGKDAVNLQIMKSQDANTVQVAREVQKKVDEFVRNESGMKSIKTMDTAKPIEDSLYTMVEKAALGTIVAIIVILLFLRNIRTTAISIVSIPMSILIALIALKLSNVSLNILTLGALTVAIGRVIDDSIVVVENIFRRLSDPNEKLKGENLIISATREVFKPIMSSTLVTIVVFLPLVFVSGSVGEMFRPFALAITFSLLASLLVSITLVPSLGATFFKNGVKNREQKEGLGTVGRAYRSALNWSLNHKWIVLIVSIFILVGSVVIGARNLGTSYISTGDNKFLALTYTPKPGETQKSVTQHAEKVQNYLDKKDKVETVQYSIGGPTPQDPTGSTNSMAIMIKYQSDTPNFDEEPDKVLKHIETFKQPGEWKNQDLGTGAGNNSVEVTVKGPNTSAMKDTVNRVEKMMTDIKGITNVKSDLSQTYDQYEIKVDQNKAADNGISAAQLAMNLNENLPEKTISTVNEKGKSIDVKVKQNKQTDWSSQKIKNIKLNKPTGGTIKLSEIASLKKSYTPSKLTQEDGDYATTVTGKVTDKDVGGKSQQVMAKVKDLEKPSHIKINVGGATDDIDKAISQLAMAMIAAIIIVYLILVITFRGGLAPFTILFSLPFTVIGVVLALIITGETISVPSLIGMLMLIGIVVTNAIVLIDRVINNEKQGMPMKQALIEAGGTRIRPILMTAIATIGALVPLLFGHDSSILISKGMAATVIGGLISSTLLTLFVVPVIYEILFTLKNKITKKFNM

SEQ ID NO: 5006 - protein, 417 aa, Staphylococcus epidermidis
TMEKMNITNQQHDAFVKSHPNGDLLQLSKWADTKKLTGWYSRRIAVGENGQIKGVGQLLFKKIPKLPYTLCYVSRGFVADYNNKEVLEALLSYAKEVAKDEKSYAIKIDPDVEVDKGAEALKNLRELGFKHKGFKEGLSKDYIQPRMTMITPIDKTDDELVQSFERRNRSKVRLALKRGTKVERSNREGLKIFANLMKITGERDGFLTRDISYFENIYDALHEDGDAELFLVKLEPKPVLDTVNQDLEAQLAEKEKLQSKKQDKKTLNKLNDIDNKIKKTNELKSDLTELEKSEPEGIYLSGALLMFAGNKSYYLYGASSNDYRDFLPNHHMQFEMMKYAREHGATTYDFGGTDNDPDKDSEHYGLWAFKRVWGTYLSEKIGEFDYVLNQPLYHLVEKVKPRLTKAKIKISRKLKGK

SEQ ID NO: 5007 - protein, 231 aa, Staphylococcus epidermidis
LSLNKLERQNRIIQTIQSSDKITASQLAKQFNVSKRTILRDIDELEDQGVKVYARHGKLGGYQIKDAHAKITLSLTEQQLSALFLTLNESQSNSTLPYQNEIRAIIKQCLNLPQTRLRKMLKKMDYYIKFEDSNHVTLPQLFSDILIYCTERNVMLVDLNENNQIQAENVIFIGLICKNAVWHAVVFEIGRGYTRELSILDIQDISYSFEKTIQTQDISIENYRQFLAPSE

SEQ ID NO: 5008 - protein, 263 aa, Staphylococcus epidermidis
AIMKIKHIFIIILTLCVVLAGCTNEKGQNKEQNEKQSTKGDKQELQVSAAASLTEVSKALGNEFKKDHPNVEIKFNYGGSGALRQQIEAGAPSDVMMSANTKDIDLLKKKNKAHDTYNYAKNQLVLIGDKNKSYTSVKDLNQNDKLALGQIKTVPAGKYAKQYLDDQHLYGDVKDKIIFAKDVKQVLNYVEKGNAQEGFVYKTDLYQQKKKANKVKVIEEIKLSKPITYKAGATSDKKLAKEWINFLKSNKAKQILKEYQFSV

SEQ ID NO: 5009 - protein, 424 aa, Staphylococcus epidermidis
SVMKNFILSVQHLLAMYAGAILVPIIVGTSLKFSAEEIAYLVTVDIFMCGVATFLQANKVTGTGLPIVLGCTFTAVAPMILIGQTKGLDVLYGSLLISGILVVLIAPFFSYLVKFFPPVVTGSVVTIIGINLMPVAMNYLAGGEGAKNYGDTKNLILGGVTLLIILILQRFTKGFLKSIAILIGLAIGTALAGIFGMVDIKQVGDAHWFGFPVPFRFSGFGFDVSSILVFFIVAVVSLIESTGVYHALSEITGRKLERKDFRKGYTAEGLAIILGSIFNAFPYTAYSQNVGLVSLSGAKKNNVIYGMVILLLICGCIPKLGALANIIPLPVLGGAMIAMFGMVMAYGVSILGNINFQNQNNLLIIAISVGLGAGISAVPQAFKGLGEQFAWLTQNGIVLGAISAIILNFFFNGIKYKQTEENVK

SEQ ID NO: 5010 - protein, 163 aa, Staphylococcus epidermidis
RRIDTMILQIVGMKNSGKTTLMNHAISFLKERGYSVATIKHHGHIGEEIELQSSDVDHMKHFAAGADQSIVQGHHLQQTVTRKKKQSLREIIENSVTIDYSIILVEGFKEANYDKIIVYKNNDELRSLQGLSHVIGKIETNHPRANNQLEHLLNKLIKDKGMN

SEQ ID NO: 5011 - protein, 262 aa, Staphylococcus epidermidis
ELVEMLKNTRLRMTTLFIISILVILAILFLIFDTNLFKNDVKHTFKEAVSLQTSEGNIHTKEVNGKFIYASKQDIEKAMQIKHSDNDLKYMDISEKVPMSEKEVNHILKGKGILENKGSTFIKAQDKYEVNILYLISHALVETGNGQSDLSKGIKEGNYHYYNFFGIGAFDEDAVKTGKSFAKQKKWTTPEKAIMGGAWFVRYHYFKNNQLSLYQMRWNPQNPGQHQYASDIQWANNIADLMEKYYDKYGIKKDHIRKKYYK

SEQ ID NO: 5012 - protein, 208 aa, Staphylococcus epidermidis
EAYEMSNPIKIGIGGPVGAGKTQLIEKVVKRLAKEMSIGVITNDIYTKEDEKILVNTGVLPEDRIIGVETGGCPHTAIREDASMNFAAIDELLERNDDIELIFIESGGDNLAATFSPELVDFSIYIIDVAQGEKIPRKGGQGMIKSDFFIINKTDLAPYVGASLDQMAKDTEVFRGNRPFAFTNLKTDEGLEKVIEWIEHDVLLKGLT

SEQ ID NO: 5013 - protein, 78 aa, Staphylococcus epidermidis
LKYEGTFSMLTKEFAQRVELTEKHVRKIVQHLEERGYHLSKTEYRGREATDFKEDDIELFTDIANKVKQTNSYDLSFE

SEQ ID NO: 5014 - protein, 150 aa, Staphylococcus epidermidis
YDNEVLNILTNEFFNSFIGIYRPYIKLTQPILDQHQIHTGQWLVLRDIANYQPTTLVKISHRRSIEKPTTRKLIKVLLDNGWVMTKTGVDKREKLLSLTDKGQILFETINKKVTVIQQDIIKKTGLTDEQVFDITNAMSQIHEAMIKEEQ

SEQ ID NO: 5015 - protein, 276 aa, Staphylococcus epidermidis
NEGEIMTELYLKKLDEYICQWIRGLDDIIPRLVEKMETSTKKDRFDLVTNVDKQIQNHFQNFLQEHYPTHQLLAEEKDNSDITPYEGHLWIMDPIDGTSNLVKQQEDYCIIIGYFIDGEPKLSYIYDYPHQRLYRAIAGIGAYENNQLMTMPKRIGLREAIISFKPQVLKEETVQSLFQSAFDFRSIGSCGLDSIRVIKGQFGAHINTNPKPWDISAQFLFARELGLIMTQINGEPLDFSKAGPFIISNPGCYDDMIRILNEGGGYSKSSHHIERG

SEQ ID NO: 5016 - protein, 270 aa, Staphylococcus epidermidis
LKLDFVKMSNNMWRGIKLNLKLDHIIHYIHQLESFKFPGEILELQNGGRHHHLGTFNQIAPIKNSYIELLDVENESKLNNVAKTEEGRVSFATKIVQDHFKQGFKGICFRTKDIDQVKSSLENRGVDVIGPIDMERENKKGHQLSWRLLYIANPDYRVKPPFFIEWDNSKKQNLSQIHNFNLSSFKIKEVIITSTQRETTVSLWKEWYNLKIVNETATSTDLKLETDEVIYKIEDGKDSGFHTLIMTDINATAPYSIFIRGAKYRFEPPN

SEQ ID NO: 5017 - protein, 64 aa, Staphylococcus epidermidis
PFEEENDTMDLNSKLSELKYDYTRLQNDLEKRESLHQDIDPLLKQLENIEQEISYIRSKLNQQS

SEQ ID NO: 5018 - protein, 249 aa, Staphylococcus epidermidis
LRKDYHQMQQQKIKRFLAHFVLDHVTIEYLKYGHQLTIEQLKLLIFILHFTENHKEDLSLNMIIFYKNYQKNQLLKSITHLYEFNWISKKRHPYDQRRLVITLTQNQCSKITQLIDELEHFLEVKSTLINEINHSTLLSYYLKCHSQFRVIEQSCTSQHLTLEELYLLGLLIVSDNKTTFKSIKVHALKGIIAMGPIIKTLQSKGYLIKSRSRDDERYIVLTLRKEKINVIQSEIEECYNKLEQGIQHV

SEQ ID NO: 5019 - protein, 70 aa, Staphylococcus epidermidis
RMNWRYSKMGYIILFFIAGPVIIGVGNLILGPIFNKRTPLHVQFRSFIIGSLVYLILATICYFLFLQGKL

SEQ ID NO: 5020 - protein, 261 aa, Staphylococcus epidermidis
ITFCKSKFKNGDPFTIALFGVDSDEKRKQQGGGERSDTIMVLSINPKEKKTELVSIPRDTKAEIAGRGTEEKINHAYAYGGPNMAVKTIEKLMNVPIDHYATIDMDGLHDMIDTLGGVDVVSNSTFTMGANHFVKGEKTHVDGDAAMDFIRSRKEDGAGGDFGRQERQQLILEAMADKLTSASSITHFNTLMNQIQKNVKTDLKLGDLNTIRTKYKDANDQVNRHQLEGEGGIQNDGLYYFIPSDASKNENTQLLRDNLNL

SEQ ID NO: 5021 - protein, 335 aa, Staphylococcus epidermidis
LFALSYFTILFIKEGVMVMTKVYIAGAIPEVGLNLLKEHFEVDMYDGEGLIDKETLKKGVEHADALVSLLSTSVDKDIIDSANNLKIIANYGAGFNNIDVEYARQQNIDVTNTPHASTNATADLTIGLILSVARRIVEGDHLSRTTGFDGWAPLFFRGREVSGKTIGIIGLGEIGGAVAKRARAFDMDVLYTGPHRKEEKERDIGAKYVDLDTLLKNADFITINAAYNPSLHHMIDTEQFNKMKSTAYLINAGRGPIVNEQSLVEALDNKVIEGAALDVYEFEPEITDALKSFKNVVLTPHIGNATFEARDMMAKIVANDTIKKLNGDEPQFIVN

SEQ ID NO: 5022 - protein, 182 aa, Staphylococcus epidermidis
YNYSCIKSFFLQMEVKPIMDKHTNYNELESKNVSDQTSSDNLSNDNIVHQQSTIQNEESQDNRLMAMLIYLLSLFTGIIGPLIIWLIKRKESRLVDVSGKTYLNYFISYTIYSTVGVICMFMIVPLMNISESLAIFSLILLLVVVFILLALLIMSFVCTIIACVKYMSGKTYTIPLTIPFIK

SEQ ID NO: 5023 - protein, 110 aa, Staphylococcus epidermidis
KGWLFMKLYLILLPVLYLIVSYISIFKMHSVITRILRIVMGILLLFVVALTTLQFPKENWWVFVVLLLLVGNVEVTGFKELKDDKKGVSILNILSLLLFVIFIILIFILY

SEQ ID NO: 5024 - protein, 494 aa, Staphylococcus epidermidis
NWRLFLMWENKFAKESLTFDDVLLIPAASDVLPSDVDLSVKLSDKIKLNIPVISAGMDTVTESKMAIAMARQGGLGVIHKNMGVEEQADEVQKVKRSENGVISNPFFLTPEESVYEAEALMGKYRISGVPIVDNQEDRKLIGILTNRDLRFIEDFSIKISDVMTKDNLITAPVGTTLDEAEAILQKHKIEKLPLVENGRLEGLITIKDIEKVLEFPYAAKDEHGRLLAAAAIGTSKDTEIRAQKLVEAGVDALIIDTAHGHSKGVINQVKHIKETYPEITVVAGNVATAEATRALFEAGADVVKVGIGPGSICTTRVVAGVGVPQITAVYDCATEARKHGKAIIADGGIKFSGDIIKALAAGGHAVMLGSLLAGTEESPGATEVFQGRQYKVYRGMGSLGAMEKGSNDRYFQEDKTPRKFVPEGIEGRTAYKGPLQDTIYQLMGGVRAGMGYTGSENLKKLREEAQFTRMGPAGLAESHPHNVQITKESPNYSF

SEQ ID NO: 5025 - protein, 114 aa, Staphylococcus epidermidis
CNERREIKSMAWLFLMIAGSFEILGVVLLNELSRTKNKIYVIFLGLAFILSFSTLKFAMVSIPMGTAYAIWTGIGTAGGTLIGMIFYGESTRLSRILCILLIIISVVGLRLISY

SEQ ID NO: 5026 - protein, 573 aa, Staphylococcus epidermidis
ISMSFKMTQSQYTSLYGPTVGDSVRLGDTNLFAQVEKDYANYGDEATFGGGKSIRDGMAQNPNVTRDDKNVADLVLTNALIIDYDKIVKADIGIKNGYIFKIGKAGNPDIMDNVDIIIGATTDIIAAEGKIVTAGGIDTHVHFINPEQAEVALESGITTHIGGGTGASEGAKATTVTPGPWHIHRMLEAAEEMPINVGFTGKGQAVNHTALIEQIHAGAIGLKVHEDWGATPSALSHALDVADEFDIQVALHADTLNEAGFMEDTMAAVKDRVLHMYHTEGAGGGHAPDLIKSAAYSNILPSSTNPTLPYTHNTVDEHLDMVMITHHLNASIPEDIAFADSRIRKETIAAEDVLQDMGVFSMVSSDSQAMGRVGEVVTRTWQVAHRMKEQRGPLDGDFEYHDNNRIKRYIAKYTINPAITHGISDYVGSVEAGKLADLVMWEPEFFGAKPDLVVKGGMINSAVNGDANGSIPTSEPLKYRKMYGQFGGNITHTAMTFVSNTAYENGIYRQLNLKRMVRPVRNIRNLTKADMKNNNATPKIDVDPQTYEVFVDGNKITSEAATELPLTQRYFLF

SEQ ID NO: 5027 - protein, 257 aa, Staphylococcus epidermidis
LLVSGKDTMMKKDKKRQSYRFKDIVWRDFSLIAIGFLCIFIFSFIGLTIAAIAFQSINELQLTMIGTLGQFMSYILVILAFYFLHINSFVDRVKSGFDYLKKHWLFIIIVMCASFIISNVYDKLIELLPKYLQYSETQNELELNELFKSGIFIPFAFVLIVIVGPIVEELVFRHLLIGELGKKFNFIVMGVISALSFTYIHVSDAKSPFEFGAYLILAIALVYVYLKSNRNLASSISLHMLNNFISFIWTIIVVFSK

SEQ ID NO: 5028 - protein, 68 aa, Staphylococcus epidermidis
KKWRSLILTIIIGLIVIILLIISLLPNYKAMVLAKQQGQKPTRYTIMVGIDLLLIILIIVTLVLKLIM

SEQ ID NO: 5029 - protein, 229 aa, Staphylococcus epidermidis
IILGRGYNMEFKVIESAKDPLFNEALKLYDDKLDIGLDEDSKIFKRSLENNKTENDYAFIVGIENQTVVSLATAHYEATTNSAFLIYLIAKESPNHDERMSLTLEAIEKQLNLLSQEVHNRDINFIMLEVPKEPSTANIDDKLRNALEHRRQFLFENQFEKQDDIDYIHPNQNQKETPQKVDLFIKANIELTKDIYGTSVKSNYILKYVFANGISREIIYPLLKEMNLR

SEQ ID NO: 5030 - protein, 249 aa, Staphylococcus epidermidis
SYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 5031 - protein, 84 aa, Staphylococcus epidermidis
SKKGESKMKILYFAELKELLNQSTETIHLDTTLTVQEFESYLLKHHSELKSKKFQIAVNEEFVRQDDIVQPGDTIALIPPVSGG

SEQ ID NO: 5032 - protein, 218 aa, Staphylococcus epidermidis
ILKGDDNMYKAVVFDFDGTVIDTEKHLFDLINTHLKIHQVAPISLEFYKQFIGGEATELHTYLEDAIGFKNKEKIYDQYYQTSVELPVNPTIIQLMQYLKKRHIPMAITTSSYKKNIYPIFKQLGLDTYIDVVVGRENVDSVQPNPEIFLKAVQELNYNPTNCLAIEDSVNGATAAMLAGLDVVVNTNIITKNQDFSTVQCVGQDMEFEDIKNFLFKE

SEQ ID NO: 5033 - protein, 78 aa, Staphylococcus epidermidis
LVEGHTKPSDCLKVRDDMLGKCHKLFTERKEFTGDTPVIVNIGEWDEGDEEDKQRALDKIKENYPNRTMIVDDIPLED

SEQ ID NO: 5034 - protein, 125 aa, Staphylococcus epidermidis
YIRGKLTMTDAITAPVKVNTTGKCKILVKNSPTGLLVENIINSIKPRTVGGNTIGKMIKLSNRFTQYLFLLYSHLEIKMPKIVTIIVLIKATRKEIQKDVKSGIALNSLYRKLIFFKNLFSFIGF

SEQ ID NO: 5035 - protein, 264 aa, Staphylococcus epidermidis
FSGGYLTMKKIATATIATAGIATFAFAHHDAQAAEQNNDGYNPNDPYSYSYTYTIDAEGNYHYTWKGNWSPDRVNTSYNYNNYNNYNYYGYNNYSNYNNYNNYSNYNNYQSNNTQSQRTTQPTGGLGASYSTSSSNVHVTTTSAPSSNGVSLSNARSASGNLYTSGQCTYYVFDRVGGKIGSTWGNANNWANAAARSGYTVNNSPAKGAILQTSQGAYGHVAYVEGVNSNGSIRVSEMNYGHGAGVVTSRTISASQAASYNYIH

SEQ ID NO: 5036 - protein, 387 aa, Staphylococcus epidermidis
VIGGVNVMESFLIHTDIQKKWIRKFKKIESEFKARAAENDIQSRFPYENIEWLIKEGYTKLTLPVEYGGEGATIEDMVILQSYLGTIDGATALSIGWHLSVIGQLYEQHMWTPSMLDSFAKEVVHGALINRAVSEAETGSPTRGGRPSTHAVKAENGYVINGVKTFTSMSKALTHYIVGAYVEETKSMGFFLIPQSTKGVSIADNWDMVGMRATESHDLILDDVYVPNENFVESKRESRPNGWLLHIPSCYLGIAQAARDYAVDFAKNYRPNSITGTIDSLPTVQQNLGKMESLLLSARHFLWSTARGYQSYTEDAQIWNETSASKVVVMNQSIEIVDLAMRIVGAKSLEMSRPLQRYYRDIRAGLHNPPMEDMAYTNIAKSITNKL

SEQ ID NO: 5037 - protein, 151 aa, Staphylococcus epidermidis
VMIIEEIQGNIANLSQDEKQKHVEKVYLENSDLVKRIQRVKTDHGNEIGIRLKQPIDLQYGDILYQDDTNMIIVDVNSEDLLVIKPRNLKEMGDIAHQLGNRHLPAQFTETEMLIQYDYLVEDLLKELGIPYSHEDRKVNQAFRHIGHSHD

SEQ ID NO: 5038 - protein, 305 aa, Staphylococcus epidermidis
MEAIKLKLIKVILSSISQVVLINNPYTGLFILIGLFAVNWKVGISAMIASVMTWILAPYMNYTKEEIESGLAGFNPVLTAIALTLFLDSNWSGILITFVATILTLPIGAAIREVLKPHKIAFLTSPYVIMTWITLLIPNQLKTLHTQIDIIPEHIEKVSLNNDHTSVHFFQSVLDGFGQIFLMPSIIGGLLILIGIFIGSKKAGIVSIIANIIGFLIIILLGGDYSSINEGIFGYNVVLSAIALGVTFETAIHSYLAMILGIVLTAFIHLGLSTLLAPLGLPTLTWPFIFATWIMLFAGIKNQTV

SEQ ID NO: 5039 - protein, 660 aa, Staphylococcus epidermidis
GRHMRENYSIRVFNNLAINTENALSVKVFYCLKGKCEVTINVQKHILEKDDIAFVVMNDTYSLLSNTETMCCIIDIPIHRYLSQKDTQFLISGTKIDESSRDRIKYWILKILELHCLSYNDVSEIQRLIQFLLIELSYLKKPKLDVNKDFYLSEDIHQYLVDHHDSKINKHELAEAVNLSNQALTSMFKQTPFQTFNQYLNQLRLKFCLIDILTTHKPIEEIAIDHGFHHYSRFIQLFKNTYGYTPKLIRRDYIATSIFKNTAEEIDLDRHFLMNIHELQDLDSKIISKKYIKMSDKGKKYRSYDIYIEDNRSTILDQEQIVHIKRNLSLSQKSMRYVIELNYTSMIENKELCRYEMLKILRFCSGLNLIPTFKIITDRHDTFTSKEKMALKLTFQMLFIMLREFNQLEIEFIVEDMMLKQVVQLKKMISSYFEYYKLNYRIKNEKIGNVNYQNLEKQVTQIFIPIDQLHLYIKEISFEKVILETSYLTDLKSEIVEYSWIQHIHTLIKMSGEVRGVLIQPSYDYAATYTYHSNLKPYHILSYVIRMFNQLRGTIVYKDDAIIMTKYKYEYQAIAIFLKNRIKENVNHQQLIFSDIQSLNHAEYEYIEMMPLLMNENNELDSHIPYPHQYWLAKLKSKESQQAIVDLPKMSIAHLTFLCS

SEQ ID NO: 5040 - protein, 518 aa, Staphylococcus epidermidis
RRFMTMEMAKEQELILVLDFGSQYNQLITRRIREMGVYSELHDHEISIEEIKRMNPKGIILSGGPNSVYEEGSFTIDPEIYNLGIPVLGICYGMQLTTKLLGGKVERANEREYGKATINAKSDELFFGLPSEQTVWMSHSDKVIEIPEGFEVIADSPSTNYAAIEDKKRRIYGVQFHPEVRHTEYGNDLLRNFVRRVCNCTGEWTMENFIEIEIEKIRQQVGNRKVLCAMSGGVDSSVVAVLLHKAIGDQLTCIFVDHGLLRKGEGDMVMEQFGEGFDMNIIRVNAQERFMSKLKGVSDPERKRKIIGNEFVYVFDDEAAKLTDVDFLAQGTLYTDVIESGTKTAQTIKSHHNVGGLPEDMEFELIEPINTLFKDEVRALGIELGIPEHLVWRQPFPGPGLGIRVLGEITEDKLEIVRESDAILREVIREEGLERDIWQYFTVLPGIQSVGVMGDYRTYDHTVGIRAVTSIDGMTSDFARIDWEVLQKISSRIVNEVDHVNRVVYDITSKPPSTIEWE

SEQ ID NO: 5041 - protein, 68 aa, Staphylococcus epidermidis
SLYIRHLVKLVYWYLLNYTKGPYFLKYFNIKLHISTKYFGETLEGTGQAEDYRLKLSDKKASQQYEVL

SEQ ID NO: 5042 - protein, 267 aa, Staphylococcus epidermidis
GGNIVFEELENKVVLITGAATGIGKSIAENFGKAKAKVVINYRSDRHHSEIEEIKQTVAKFGGQTLAVQGDVSIEEDIKRMIETTINHFGTLDIIINNAGFENSIPTHEMSIDDWQKVIDINLTGAFVGSRETINQFLKENKKGTIINISSVHDTIPWPNYVHYAASKGGLKLMMETMSMEYAQYGIRINNISPGAIVTEHTKEKFSDPTTREETIKMIPAREIGNAQDVANAVLFLSSDLASYIHGTTLYVDGGMMNYPAFMGGKG

SEQ ID NO: 5043 - protein, 290 aa, Staphylococcus epidermidis
LPNILYKIDNQYPYFTKNEKKIAQFILNYPHKVVNMTSQEIANQLETSSTSIIRLSKKVTPGGFNELKTRLSKFLPKEVTQYNVELVDNESTISLKNKLHSRSKAALSNANETINAAIIDEICDLIKNSETIFIYGYGASFVVATDLYQKLSRIGLNIQLVHETHIFTTMLATRNSNDCVIFISNNGTQSEMQSIAKVIADYHIPIATISSTSDNPVAKQSNIVLTYGQTDENEMRMGATTSLFAQMFTIDILYYRYIALNYQSSLDFITQSKIALDNYRKHLSNIDFKH

SEQ ID NO: 5044 - protein, 232 aa, Staphylococcus epidermidis
DIRMIDHQHLRLFQFCDSQFPTGAFSHSFGLETYIQRETVHDTETFIKWLHLFINEQLTYSDGLAMRIVYHALINNDKDKILDINQKLFVQNLPKETRIGAKQMGTRMVKLALDLYDSEWIQWYYNQMKNHKIKLHPAVCFTMLGHFLGVDVESIIDYYLYQNISSLTQNAVRAIPLGQTAGQQVVTEMIAHIEKTRNHILELDEIDFGMTAPGLELNQMEHENVHVRIFIS

SEQ ID NO: 5045 - protein, 195 aa, Staphylococcus epidermidis
NISIHIIFIHILLTIGGPHMLIDKFETYIINVAGLKSRSTRKKLIHLCKEITFCESFQYSIIKQNNVFALEVSLPKLQLPYLISFLSFHNYAIYQILLPNRVNELLDSEQLYQSIKRFDLAIDGLQDAFIKDKVIDIMNMFANHHNVNYTLNNNCASVTCPPEIFTKLLQTIATRNIDILSASYRAKMLHKARIS

SEQ ID NO: 5046 - protein, 61 aa, Staphylococcus epidermidis
VSIIILPKSFFYILNFLVILFFKVNKISYITGTTKSVSSVEEINPPITVAAIPFEINIELS

SEQ ID NO: 5047 - protein, 206 aa, Staphylococcus epidermidis
MLTIKVNGVLYQTKININIEDQHPKIYAIQGPSGIGKTTILNIIAGLKSINYSYIKVGKRVLTDSQHHLNVKVQQRRIGYLFQDYQLFPNMNVYNNITFMTKPSEHINELIHTLKIEHLLEKYPVTLSGGEAQRVALARALSTKPDLILLDEPFSSLDDKTKKEGIKLILKIFEAWQIPIIFVTHSNYEAQQMAHEIITIEDCIQI

SEQ ID NO: 5048 - protein, 229 aa, Staphylococcus epidermidis
  UNSURE (167),(168),(169),(170),(171),(172),(173): Identity of amino acid at the above locations are unknown.
VATISSARICPKLSSKLTLIFFTSTCCFIIRLIASLTDIGVLFSIDIHSSPKNINFHDILTPNRREKMTHFTHINKQGNAKMVDVSNKEITKRVAEAHSSIIVNEKIYRQITQNTNSKGNVLNTAQIAGIMAAKNTSTIIPMCHPLPLTGIDISFKWDSNNDDSYRXXXXXXXSTTGKTGVEMEALTAASVTALTIYDMTKAIDKGMIIGETYLESKSGGKSGDFHRKN

SEQ ID NO: 5049 - protein, 132 aa, Staphylococcus epidermidis
LDKIIKVLYLYTSLNSFNIKFARQINMKEGIVLHFTQREQDKLMIVVAAEVARRRKARGLKLNHPEALALISDELLEGARDGKTVAELMSYGKTILNEEDVMDGVANMITELEIEATFPDGTKLITVHHPIV

SEQ ID NO: 5050 - protein, 375 aa, Staphylococcus epidermidis
NMKIAIVGAGIGGLTAAALLEEQGHQVKVFEKNTSINELSAGIGIGDNVLKKLGHHDLAKGIKNAGQNLTAMNIYDEQGTPLMSAKLKSHSLNVALSRQTLIEIIQSYVEESSIHTGFKVTKIEQTSCKVTLHFTKQESESFDLCIGADGLHSVVRESVGARTKIRYNGYTCFRGMVEDVQFNDQHVANEYWGVKGRVGIVPLINQRAYWFITVHAKEGDPKYQSFGKPHLQAYFNHFPNEVRNVLERQSETGILLHDIYDLKPLKTFVYGRTILMGDAAHATTPNMGQGASQAMEDAIVLVNCLEKYDFNKAIERYDKLRVKHTTKVIRRSKKIGKMAQKHHKLTVKLRNTAMKLIPNALASAQTKFLYKSKEK

SEQ ID NO: 5051 - protein, 307 aa, Staphylococcus epidermidis
KEGINVTEQFVIIILLIALGYFLKRMNYLKATDSQVLSTLVLNVTLPSLVIVNLNSAKLDVSFSILPIMMIIYGIVAKIIVIWFFRKYDNHMRGSVGMMTGSMNIGLFAYPLVEAIWPSKGMIYFGMVDIGGAIIMFGITYFVGSYFSEGSDQFNFKFLGKKLVQSVPLVTYMIMFGLNMSHIHIWQPAIDFFSVLSKANMPLSMILLGVMLNFSIEREYLPVTIKYLCLHYGLGMLAGTLVHFLLPVSDDMIKTTLLITWLLPVGVAIIPYSIQFKYKTLPFVGMVTNLTIIISIIILYIYQAVFV

SEQ ID NO: 5052 - protein, 282 aa, Staphylococcus epidermidis
PLLIEITLNLAIYNDKRSFIERDAEDVLPKVIAAQKVLKEIRKDVEIDAYIEHVNYNFLEQHGMHVDIILDATDNFDTRQLINDFAYKHQIPWIYGGVVQSTYVQATFIPGETPCFNCLMPQLPSINLTCDTVGVIQPAVTMTTSLQLVDALKLLTGNKVNKHFTYGDIWTGDHYTFGFSRMQNEDCKTCGNAPTYPHLNQHQQDYATLCGRDTVQYKNADISQEILLSFLERNHIQYRTNLYMTMFRFREHRIVAFSGGRFLIHGTTEPKKAIQLMHQLFG

SEQ ID NO: 5053 - protein, 362 aa, Staphylococcus epidermidis
LAMIRYQEGVFKMLGFSVYLGQNLDRDYILNMADLGYDVVFTSLQIPEEDKKNQMAYLGDLCQLLSAYQITYIIDVTPSLLNQTIYSYLNQLPHGDFYIRIDNQLNIDLIKDIISHGFKCCLNASTLTDSMLAHIYCTDFNNQLLYCHNYYPRPDTGLSISFIEEKNQLIRKYDAHAKICAFIPGTQKRGPLFKGLPTVEKHRFEHPLIAAQDLQLTGISDIIISDTLLSHIYAEQLSNMWLYRHFILHLDQLDSSFTSQVLKIHTSRLDSPEHVIRSQYSRTDNQQTVPMIGSAHRDQGDITIDNHLNGRYEGEIQVIKAPMPGHSHINCIGHVCDKDVPLLSLIQPGDTFKFVYTKENNK

SEQ ID NO: 5054 - protein, 256 aa, Staphylococcus epidermidis
GVKMILDERVNSNFDQLNDNDIQIAHYVNTHIDVCKNMKIQDLASQTHASNATIHRFTRKLGFDGYSDFKSFLKFEDSKNHQLPSDSMEQFKQEIENTFNYLERIDYRLLTHKMHHATTIYLYGTGRAQMNVAEEAQRILLTMHKNIILLHDVHELKMVLNKTIPEDLFFIISLSGETHQLKEVTQLLQLRQKYFISVTTMKDNTLAQQADYNVYVSSNTFYLNDGTDYSSFISYHIFFETLLRKYNEYKENHELT

SEQ ID NO: 5055 - protein, 287 aa, Staphylococcus epidermidis
VQIVDFLIALLPALFWGSVVIINVFVGGGPYNQIRGTTLGTLFIGFSLLATGHAAFDNLTVIIVGLVSGALWAFGQGNQLKSVHLIGVSKTMPISTGMQLVGTTLFSAIFLGEWSTIVQVVMGLIAMILLVVGISLTSLKAKSEGKSDNPEFKKAMGILLLSTIGYVGYVVLGDIFGVSGTDALFFQSIGMAIGGLILSMNHNTSIKSTALNLIPGVIWGIGNLFMFYSQPKVGVATSFSLSQLLVIVSTLGGIFILGEKKDRRQMIGIWSGIIVIVIASIILGNLK

SEQ ID NO: 5056 - protein, 113 aa, Staphylococcus epidermidis
LKGVERMILDNVNPDDLFPTEKKGPSVLGMIEYNVQGQTKFEGAFIATNERLIMNVDMNGQFYYRNIRYDEINQIHFDGSDIIFEFNIGTVPMREIKTEDVQAFVDYIKQQIQ

SEQ ID NO: 5057 - protein, 112 aa, Staphylococcus epidermidis
GFLVSPAEMPINSTPWYDQITIDKAKKNPMNPFGINPPCDHKLEIPIGFPPLPIPNKINRNPAIIINTIVTTLIKANQNSNSPNAFTETRLAAIKKRTAITPGIQLGRLGNQ

SEQ ID NO: 5058 - protein, 80 aa, Staphylococcus epidermidis
IGVVGMQRSDKRKMSLPMKILLWVVGILFLLAIIAVIYVSAKIFITGDKIHNPLNRNHSELRSAKVNLKMVIHLLLHFLA

SEQ ID NO: 5059 - protein, 428 aa, Staphylococcus epidermidis
KLIFFGDECMSIEKRTPISVKEAIKRIMKQQVEVKNINVNLDESLGHILAEDIVATYDIPRFNKSPYDGFAIRSEDSQGASGENRIEFEVIDHIGAGSVSEKTIDKNQAIRIMTGAQIPSGADAVVMFEQTIESETTFTIRKSFKHLENISLQGEEIKAGDIVLHKGMRINSGVIAVLATYGYTKVRVARKPTVAVIATGSELLEVEDELEPGKIRNSNGPMIKALAKQFGIQVGMYKVQHDNLEKSMEVVKKALSEHDLVITTGGVSVGDFDYLPEIYKSIQAQILFNKVAQRPGSVTTVAFADGKYLFGLSGNPSACYTGFELYVKPAVNKLMGTKACYPQIIKATLMEDFNKANPFTRLIRAKATLTKAGMTVIPSGFNKSGAVVAIAHANAMIMLPGGTRGFKAGNIVDVILTESNSFEEELIL

SEQ ID NO: 5060 - protein, 723 aa, Staphylococcus epidermidis
HDVFYKCERKIKMKSLILAEKPSVGRDIANALNLQQKSNGYIEGKQYIVTWALGHLVTNATPEQYNPSYKEWNLEDLPIIPKKMKTVVISKTNRQFKIVKSLILDKNVKEIIIATDAGREGELVARLILDRVGNKKPIKRLWISSVTKKAIQEGFKRLKNGNAYQNLYEAALARSEADWIVGINATRALTTKYDAQLSLGRVQTPTIQLVKSRQDEINYFKPEKYYTLSINVDGYDLKLNQQKRYKDKKELELIEHEIKHQEGKILEVKGKNKKSYAQPLFNLTDLQQEAYKRYKMGPKETLNTLQHLYERHKLVTYPRTDSNYLTDDMVDTIQERLRAILATDYKSHVRDLISKSFSSKMHIFNNQKVSDHHAIIPTEVRPSIEQLSQREFKIYMLIAERFLENLMNPYLYEVLTIHAQLKDYHFVLKEKIPKQLGYKALKDQLSSHTLTHSFKEGQLFKVHRIEIHEHETKAPEYFNEGSLLKAMENPQNHIDLNDKKYAKTLKHTGGIGTVATRADIIEKLFNMNALESRDGKIKVTSKGKQILELSPSELTSPILTAQWEEKLMLIEKGKYNSQKFIQEMKNFTFKVVNKIKSSEQKYKHDNLTTTECPTCGKFMIKVKTKNGQMLVCQDPKCKTKKNIQRKTNARCPNCKKKMTLFGKGKEAVYRCVCGHTETQSQMDKRMRDKTNGKVSRKEMKKYINKKEEIDNNPFKDALKNLKL

SEQ ID NO: 5061 - protein, 138 aa, Staphylococcus epidermidis
ILQFLEALNIMKKIKTISTLVAGLGIAFLGHTTHADAAENNNQQQSTYNYSTTEVSFSNSGNLYTSGQCTWYVYDKTGGKIGSTWGNANSWATAAQAAGFTVNNTPEEGAIMQSSEVLSDMLLSLKVLIMMVLLLYQK

SEQ ID NO: 5062 - protein, 150 aa, Staphylococcus epidermidis
MKQFEIVTQPIETEQYRDFTINERQGAVVVFTGHVREWTKGIRTQHLEYEAYIPMAEKKLAQIGKEIEEKWPGTITTIVHRIGPLQISDIAVLIAVSSPHRKAAYAANEYAIERIKEIVPIWKKEIWDDGSEWQGHQKGTYNEAKKGKAR

SEQ ID NO: 5063 - protein, 484 aa, Staphylococcus epidermidis
QLKFKKRGFVSNHTEGSKSMTQKYRYPTFLESISTILVMVVVVVIGFVFFNIPIQILLLISSAYAAFIAHRVGLKWKDLEEGITHRLSTAMPAIFIILAVGIIVGSWMYSGTVPALIYYGLKFLNPSYLLVSAFIISAMTSIATGTAWGSASTAGIALISIANQLGVPAGMAAGAIIAGAVFGDKMSPLSDTTNLAALVTKVNIFAHIKSMMWTTIPASIIGLAIWFIVGLQFKGDANTQQIQNLLKELTTIYNLNFWVWIPLIIIILCLIFRISTVPSMLISSISALVIGTFDHQFNMKDGFKASFDGFNHTMLHQSHISDNAKTLIEQGGMMSMTQIIVTIFCGYAFAGIVEKAGCLDVILETIAKGVKSVGTLILITVVCSIMLVFAAGVASIVIIMVGVLMKDMFEKMNVSKSVLSRTLEDSSTMVLPLIPWGTSGIYYAHQLNVSVDQFFIWAIPCYLCAFIAIIYGFTGIGIKKISRK

SEQ ID NO: 5064 - protein, 86 aa, Staphylococcus epidermidis
FVYSKYKERFRDLMQERYSRQVLFKEIGLKGQSLLEKKHVLIVSMGALGTHLAEGLVRAGINKLTIVDRDYIEFSNLQRQTLFYRA

SEQ ID NO: 5065 - protein, 478 aa, Staphylococcus epidermidis
GGDSMSKEERLAKDITHALGGSQNISNIIHCMTRVRIKVHNDAKVNYDELKSINGVLGVVEDERIQVVVGPGIVNKVAKLMADQSGATLAEETTENQSYKSQAEKRAYEHKKQFQSQRKQSKWNKVLKSIANIFIPLIPAFIGAGLIGGIAAILSNLLTAGSISGQWIQQIVTVLNVIKDGMLFYLAIFTGINSAKVFGATPGLGGVIGGTTLLTGITDENPIKNIFTGEHLAAGQGGIIGVIFAVWLLSMVEKRLHKIIPNSIDIIVTPTITLLLIGLLTIFIIMPLAGFVSDGLVYVINWIIGVGGIFSGFIIGAFFLPLVMLGLHHIFTPIHIELINQTGSTYLLPIAAMAGAGQVGAAIALWVRCGKNKELRNTLKGALPVGFLGIGEPLIYGVTLPLGRPFFTACIGGGVGGAVIGGIGHIGATAVGPSGISLLPLIANNMYLGYIVGLLAAYTGGFIFTYFFGTTKEMRNPE

SEQ ID NO: 5066 - protein, 167 aa, Staphylococcus epidermidis
EAFLMDWILPIAGIIAAIAFLILCIGIVVVLISVKKNLDYVAKTLDGVEGQVQGITRETTDLLHKVNRLTEDIQGKVDRLNSVVDAVKGIGDSVQNLNGSVDRVTNSITHNISQNEDKISQVVQWSNVAMEIADKWQNRYNRRGSANYKTNTVADDANHSYNSRVNK

SEQ ID NO: 5067 - protein, 366 aa, Staphylococcus epidermidis
GVRFYMTIDNSKTLERIKILTELHGAPGFEDEVRSYMKSEMEPYVDKFIQNKMGGFYGIKKSNKENAPRVMIAAHMDEIGFMITHINDNGMIQFTNLGGVANDIWQGQRLKIKNRYGKEIIGVVANIPKHFRTGNESIPQIKDLMLDIGASSSEEVRNRGVEVGDTIVPHTIMTQLSKNRYSAKAWDNRYGCVLAIEILELLKDVQLDVDLYVGANVQEEVGLRGAKAAAKQIDPDIAFVVDCSPANDIKGKQQLSGVLGEGTLIRIKDGTMILKPLFRDYLLKLAEENQIAYQYYISPGGTDGGEIHKENEGIPTAVIGVCARYIHSTDAVFDIRDYFSARHLLKESIIHLTSGQIQQLQYGKEF

SEQ ID NO: 5068 - protein, 208 aa, Staphylococcus epidermidis
KSTFKIWYTISNFRRYLMHFNKYQILTTDKYTKFEHLYKKVKHICVVIFLVVFLIGFIILLSLVLYFQQLTKDASSISDRELKAKILHIPGDELINHNNQILEEYDHSQNTLIVGPNHVNSNIIHALTASEDTLFYKHNGIMPKALLRAMLQDITNSNQSSGGSTITQQLVKNQVLSNKKLIVVKQMKLSWLHGSKIYYQKMKSYIRI

SEQ ID NO: 5069 - protein, 212 aa, Staphylococcus epidermidis
MSMFTGIIEEIGTVQQVRSEQSVRTLEIKAQNILVDMHIGDSISVNGACLTVIDFTDSSFSVQVIKGTENKTYLGSVQRNTEVNLERAMSGSGRFGGHFVLGHVDELGTISKINETANSKIISIKTTKNILNQMVKQGSITVDGVSLTVFDLHDYTFDIHLIPETRRSTILSSKKVGDKVHLESDVLFKYVENIMNQNQSQLTEEKLRAFGF

SEQ ID NO: 5070 - protein, 246 aa, Staphylococcus epidermidis
PFTFRRRNDMTKLNVKVFADGADIEEMKSAYKNQLVDGFTTNPSLMAKAGVTDYKAFAEEVVSEIPDASISFEVFADDLPTMEKEAEILKQYGDNVFVKIPIVTTTGESTLPLIKRLSSKQVRLNVTAVYTIEQVKAITDAVTEGVPTYVSVFAGRIADTGVDPLPLMKESVKVTHSKEGVQLLWASCREVYNVIQADEIGADIITCPADVVKKVNNNLGRDIGELSVDTVKGFAKDIQSSGLSIL

SEQ ID NO: 5071 - protein, 507 aa, Staphylococcus epidermidis
NVTTNNKYIRMIYMRVAIIGMGTAGVSVLRQLVKHENFSQLKVDVYDDDRNMGQGVPFQNDSSELLINMPSKSMSLNLDDDQEFWKWYQNQTEFNFSNPQYLPRFVFGHYMKSYLSYYNDQFDNLTIINDKVQEIFTQSDVDDTDLKYHVCTCDDEKEWREYDYLFLTFGTFSYHDPYDLKGTKGYIQTPYPTYHTLDNVKDSDRIVIIGTGLASLDAVRYVAAHHPSLPITMTSRSAALPSVRGKMTKIQFTHLTKSRFNGIMKNHFGNVPLEKVVSLFLKECEDYGIDFKKLIYRRTGNHVKDLEYDLNHEEEMGIFQSIIEHLKENLNWIWNSLSVKDQETFNRKYTKIIQLNSNPMPPRTARLLIKLIQNNELVIKKGLEDIVHKNNQFMLKYNDTTQNYELFDIVINATGSKTHLSQLDEDDQLILNLENRQIVQRHPMGGIQIIPETNQVISPRYGTLKNVIAIGQMTNGVNKLRNGVKMIVNQVVDTVSQLYITQENRNK

SEQ ID NO: 5072 - protein, 61 aa, Staphylococcus epidermidis
KRHTKASVQKLNNCFSQAFKDALNEEIIERDQTWNDPIYERKPTKKEEDKFMSLTEYRKLK

SEQ ID NO: 5073 - protein, 220 aa, Staphylococcus epidermidis
ACNTLFCFFITTKKKKEESHMARFRGSNWKKSRRLGISLSGTGKELEKRPYAPGQHGPNQRKKLSEYGLQLREKQKLRYLYGMTERQFRNTFDIAGKQYGVHGENFMILLASRLDAVVYSLGLARTRRQARQLVNHGHIEVDGGRVDIPSYSLKPGQVITVREKSQNLDIIKESVEINNFVPEYLDFDADNLKGTFVRFPERSELPAEINEQLIVEYYSR

SEQ ID NO: 5074 - protein, 76 aa, Staphylococcus epidermidis
KGGTFMDYAHLNLEHFFARNDDLDIIRDRSDFVMINNFTNEMKYREGEIEGTIDLNQYYYKNRSQAVSFIMMNYKN

SEQ ID NO: 5075 - protein, 365 aa, Staphylococcus epidermidis
VEMTNKLEQYREEIVSLNDQVLELLSKRGELAQKIGEEKIKQGTRVYDPQREKEMINQLLDKNKGPFNDNVIKQLFKEIFKASTDLQKSENEKHLYVSRKLKPEDTIVKFDNGGIIGDGNKSFVFGPCSVESQEQVDAVAQDLQAKGEKFIRGGAFKPRTSPYDFQGLGVEGLKILKNVKDKYNLNVVSEIVNPNDFEIASDYLDVFQIGARNMQNFELLKEAGRTDKPILLKRGLSATIEEFIYAAEYIASQGNRNIILCERGIRTYEKATRNTLDISAVPILKQGTHLPVMVDVTHSTGRKDIMLPTAKAALAVGADGVMAEVHPDPSVALSDAGQQMDLNEFNQFYHELKPLADMYNSKKLK

SEQ ID NO: 5076 - protein, 75 aa, Staphylococcus epidermidis
TAVTFNLTCFDDKRLINGSVDSPVVVTIGIFTNTLSPYCFKISASFSIVGKSSANTSKEIEASGISLTTSSAKAL

SEQ ID NO: 5077 - protein, 415 aa, Staphylococcus epidermidis
LSYLKRIFVIYLKEKMMTYNKRLFTSESVTEGHPDKIADQVSDAILDEILKDDPNARVACETTVTTGMALISGEISTTTYVDIPKVVRETIKDIGYTRAKYGYDSQTMAVLTAIDEQSPDIAQGVDKALEYRNDISEEEIEATGAGDQGLMFGYATDETDTYMPLPIFLSHQLAKRLADVRKDEILDYLRPDGKVQVTVEYGEDDKPRRIDTIVVSTQHAEDVELAQIEKDIKTHVIYPTVDKALLDDETKFYINPTGRFVIGGPQGDAGLTGRKIIVDTYGGYARHGGGCFSGKDPTKVDRSAAYAARYVAKNIVAAGLAKQCEVQLAYAIGVAEPVSISINTFDTGKVSEARLVEAVRKHFDLRPAGIIKMLDLKQPIYRQTAAYGHFGRTDVLLPWEKLDKVNVLKDAVEIQ

SEQ ID NO: 5078 - protein, 195 aa, Staphylococcus epidermidis
NEQAEYTIMKLERILPFSKSLIDSHINHNSIVIDATCGNGNDTAYFAQHVPNGFVYGFDIQEQAILNTHKKTKDYSNVKLIQSGHENAKLHIPAQHHGCIDAAIFNLGYLPKGNKEIVTKPETTIMAINEIFDILSIEGIIILVIYHGHEEGKVEKEALLEFLQNFDQNKAHILQYQFINQKNNAPFICAIDKRN

SEQ ID NO: 5079 - protein, 375 aa, Staphylococcus epidermidis
GMKAILFDVDGVFLSEERCFDVSAITVAELLSSPDFLNCDIDIHFDGNLTENDINKIRRNVFNNDRILNQLKSLGLNSNWDMLFIVFSIHLIDKAKQLKPSLRDQLLDELLFTKETLKEIAKDLTDKTINYSLPYDVIASFRNGKDAIYEDLEVYAKNQLELNNTSLFKLKSALWTLAKDIYQEWYLGKALFNQVEYKKDIQDFKKGFIYDEVILKPIEEIQLLLQNLIEAGYQIAIATGRPRTETIIPFQSLGLKSYFKDEHIVTASEVLLAEKQFPQYQPLGKPNPFSYIATLNGNYNDQYERYATKQEDIVNKDEVYIVGDSLADLLSAKKIGATFIGTLTGLKGKAAHSELVANGADHVVEDITKIRKILL

SEQ ID NO: 5080 - protein, 3696 aa, Staphylococcus epidermidis
EANLMNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKTNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 5081 - protein, 66 aa, Staphylococcus epidermidis
LIIYIKSTFMFKIIMKVVFLQKAPNDFKYKFIWGEVIVIGFYYYYIISILPQSSIISMICPDTASA

SEQ ID NO: 5082 - protein, 118 aa, Staphylococcus epidermidis
FSTYSIYCLLFFFISCIRRVLNMINLFICFILYCLSSFRFHSSCWCYIFYFIYSISFRFIYLISSTIALNIIFCFNLSFFNFTIRFLNFFICSIIYSLNFYFLISCFNINIIFSISFN

SEQ ID NO: 5083 - protein, 282 aa, Staphylococcus epidermidis
RRDYMETVQFYNGRTMPKIGLGTYRVKDGDECRESVKYAIERGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNKLRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFDGK

SEQ ID NO: 5084 - protein, 72 aa, Staphylococcus epidermidis
LSILTIRNVSSSLSNLNSTSKCFKRAFNLSLIWKTFIINTPYFRTFLQFTINNVELTEKTQIITLICYYKLM

SEQ ID NO: 5085 - protein, 248 aa, Staphylococcus epidermidis
GGILMRKLFLSILSIIIISSFCVATGFQNVNAANNEVSKPQSNVDSKTKQNIIKKIKKSNAYKKHANSTSIDSIKDDDIIVHLDKGKNTNVYSINYVFGKKLAKMNDNLAMIELKYNEANNEVFYNHMMYSKFVKYNNKEYINMKGILNGKPYYEFNIDQKGHYYDKNFKHTSKDEIEKDSAKNLPPKERGWCEWAVGALCGTGGAAGCWATATALGITTGWGGFSLTTICGLISSLGCTGATNYICK

SEQ ID NO: 5086 - protein, 101 aa, Staphylococcus epidermidis
KVAYKTMQLKYNEINKNQLISSETPFLENFQDCIKINKKNKISQSTLNCYYNALNIFDEKFGNTAIKNFSQLKYSEMLKEYAEGHIIGGHKKDIRKQVFKN

SEQ ID NO: 5087 - protein, 121 aa, Staphylococcus epidermidis
MQYLYIFVGGALGALIRFCLSMLNEGSTIPLGTFVANLLGAFLMGSIGALSLSLFKTHPNIKKGLTTGLLGALTTFSTFQFELVTLFNQHHFILFTIYGVTSYILGILSCYLGVKIGGRFS

SEQ ID NO: 5088 - protein, 69 aa, Staphylococcus epidermidis
FYHLYYSKSSSIKIYLNIFLNDIRICFLRSTLNYLMIFISKKVRLRFQIKILIVLSDHICDLQCNSRIY

SEQ ID NO: 5089 - protein, 574 aa, Staphylococcus epidermidis
YLIQSMLSILYIVTISILKWINSIGMLYYLNVRAYINYRMEGLGMSIDTYTETLKINQLIEKATSHFQLSSTQLYKKILKNHEGELTELGAINVKTGKYTGRSPKDKFIVTEPSYKDNINWGDINQPMDEETFLKLYNKVLDYLNQKEELYIFSGYAGSDKESRLKLKVINELAWHNLFARNMFIRPESIDEAQNIKPNFTIVSAPHFKANPKLDGTHSETFVIISFKHKVILIGGTEYAGEMKKGIFSVMNYLLPMQDIMSMHCSANVGEKGDVALFFGLSGTGKTTLSADPKRKLIGDDEHGWNKNGVFNIEGGCYAKAIHLSKQKEPQIYNAIKYGTILENTVTNDDGTVDFDDNTYTENTRAAYPIDYIENIVTPSKAAHPNTIIFLTADAFGVIPPISKLTKDQAMYHFLSGFTSKLAGTERGVTEPQPSFSTCFGAPFLPLSPTKYADLLGNLIDIHDVDVYLVNTGWTGGKYGIGRRISLHYTREMVDQAISGKLKNTKYIKDDTFGLNIPVQIDSIPTTILNPINAWNNKDNYKAQAYDLIQRFNNNFKKFGKEVEHIANKGAFNQ

SEQ ID NO: 5090 - protein, 83 aa, Staphylococcus epidermidis
PLDQGAMAPQVGFEPTTDRLTADSSTTELLWINKMERVMGIEPTTSAWKAEVLPLNYTRLMKYDYGAVEGNRTLECRNHNPMR

SEQ ID NO: 5091 - protein, 174 aa, Staphylococcus epidermidis
TPAQKEDEKFMSIENFVNLKKYVSDPPIQSYVFVYILIVTGGRFGEVQKLSRSDLDYKNNTIHLPGTKTETSDRTVDIPAADMNMLRKTLSKMPVSLSNQLFSTGVGLITHNAVSKVLQKFCLENKIGKYTLHSIRHTHCSYLLLNDVSIYYTSKRLGYKNIKTTMDAYFASIR

SEQ ID NO: 5092 - protein, 66 aa, Staphylococcus epidermidis
RIKQPQVLQQLSQLLSVKKNPLKQRSFISFNNSNYNRKKAYFRHIFYNYLFSILQVIEFQQHLLKH

SEQ ID NO: 5093 - protein, 397 aa, Staphylococcus epidermidis
EEYNMQFDTIELAIEALRNGESIIVVDDEDRENEGDLVAVTEWMDDNTINFMAREGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTDYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 5094 - protein, 65 aa, Staphylococcus epidermidis
VRILPVEPWLLGQAVKTPPFHGGNTGSSPVGVIQTEVKYRFCFFIIIFYHGELSELAEGARLESV

SEQ ID NO: 5095 - protein, 336 aa, Staphylococcus epidermidis
NVYKEEIMTVTIYDVAREARVSMATVSRVVNGNQNVKPETRNKVNEVIKRLNYRPNAVARGLASKRTTTVGVIIPDISNVYYSQLARGLEDIATMYKYHSIISNSDNDPEKEKEIFNNLLSKQVDGIIFLGGTISEEIKSLINQSSVPVVVSGTDGKDDHIASVNIDFKQAAEEATQYLIEKGAKTFSLIGGEYSIKAQDDVLEGLKNVLSQHQLKLDDTLHLTGNESYKSGIKTFEQLQSNLPDAVLCISDEQAIGILHSAQDAGVKVPEDLQIISFNNTRLVEMVRPQLSSVIQPLYDIGAVGMRLLTKYMNDEEIENPNVILPHRIEYRGTTQ

SEQ ID NO: 5096 - protein, 293 aa, Staphylococcus epidermidis
FNNNDLRGVNMTKHKKGSILAIIGLLIVFVVTGFIFFSMISDQIFFKHVKPVEKVEKLDKTLDKASKKQIHNYTSQQVSNKANTAWRDASGTEIKEAMDSSKFIDDDKQKYQFLDLSKYQGIDKNRIKRMLFDRPVLLKHTDDFINAAKSKHVNEVYLISHALLETGAAKSELANGVEIDGKKYYNFYGVGALDSDPIKTGAEYAKKHGWDTPQKAIYGGADFIHKHFLSHDDQNTLYSMRWNPKNPGEHQYATDIKWAESNANIIADFYKNMKTEGKYFKLYVYKDDDKHQK

SEQ ID NO: 5097 - protein, 260 aa, Staphylococcus epidermidis
GKLNKFKRKVTLMKFRRPNQHFQIVAHRGLPEDYPENTIIAYRHALMLHIDMLEIDVHYTKDKELVVIHDDTIDRTSNGKGKVSDFTLKELKALDFGFYKGEKFKGESIPTFDEVLDLADNFSQKLLIEIKKPSQYPNIENMIVDKLKERQISKSKVILQSFDFDCVKKLSAMNLDYELGLLISKKKYWHKLPNFKKIAKVADYANPNYQIVSKKFMQLAHEEELKVLPYTVNKLKESQKLIDIGVDGIISDVPEDLFEL

SEQ ID NO: 5098 - protein, 183 aa, Staphylococcus epidermidis
LFSNNKLTSIYPEIILCAQIGVNYMSFEEAYKKYNNIIHYLLKSYQITYNYDEFYQQMLIKMWQLTLDFDEQQSSSFKSYLFIRLKFYLIDLFRQKDNTLNICSIDALSELSPSFSINEIDLLIKDISQQLLPRERDWLTLYLQGYKQYEISQILDFSLTTIKKIKSNAIRKLRRYLNSSTKD

SEQ ID NO: 5099 - protein, 150 aa, Staphylococcus epidermidis
ELTKERCKMGKSTNLFKIALGIGGAITVVALSRKESRDKLKQEYNKYKENPESYKSSAKDLATQIGNKANETIQEVKKNPKDYVERIKSNPKEFLEEEKSKIIGKNDQTQDDIEEGKFDAEGGATVNNNLRVVTEDDLKNNKNALQDKKE

SEQ ID NO: 5100 - protein, 283 aa, Staphylococcus epidermidis
FMTKVFINGEFVNEEDAKVSYEDRGYVFGDGIYEYIRAYDGKLFTVKEHFERFLRSAEEIGLDLNYTIEELIELVRRLLKENNVVNGGIYIQATRGAAPRNHSFPTPPVKPVIMAFTKSYDRPYEELEQGVYAITTEDIRWLRCDIKSLNLLGNVLAKEYAVKYNAAEAIQHRGDIVTEGASSNVYAIKDGVIYTHPVNNFILNGITRRVIKWIAEDEQIPFKEETFTVEFLKSADEVIISSTSAEVMPITKIDGENVQDGQVGTITRQLQQGFEKYIQSHSI

SEQ ID NO: 5101 - protein, 415 aa, Staphylococcus epidermidis
IEKNIKRGTHDMNIPKSVWWLVIGMALNITGASFLWPLNTIFMKEELHKSLTIAGIVLMINSFGMVVGNLLGGSLFDKLGGYKTILIGTFTCYVSTTLLNLFHGWPWYAIWLVLLGFGGGMIVPAIYAMAGAVWPNGGRQTFNAIYLAQNIGVALGAALGGFVAEFSFNYIFMANLIMYVLFAIVAITQFNLEINAKFKPQDSIDLKSKENKKRFTAMMLVCAMFAICWIAYIQWETTIASFTQSINISMSQYSVLWTINGIMILVAQPLIRPIIILLKGNLKHQMFVGILIFMSSFLVTSFANHFAIFVVGMVILTFGEMFVWPAVPTIANQLAPVGKQGQYQGFVNSASTVGKAFGPFIGGILVDTFNMSMMFIGMIILLSFALLFLSFYDKVLPKNFKNQHQSRRRRNQNGI

SEQ ID NO: 5102 - protein, 156 aa, Staphylococcus epidermidis
LILKRGTYQMSKNEFIKRVNKQLWFLNAKEEDALNKYIDSVDQNKSIDTHKPIRFSNEYLKKFIFNHKKKSTSHVFVLLICMVLAYAFLLGLFILGLVASLAIVHAYINPNIDLSVFVILTVLIVAIIIMIASLYAIKHTTALFTKKLLEYKFNKR

SEQ ID NO: 5103 - protein, 157 aa, Staphylococcus epidermidis
EDSKMNFEGKLVGKDLKIAIVVSRFNDFITTRLLEGAKDTLIRHEVEDTNIDVAYVPGAFEIPLVAKKLAQKGEYDAVITLGCVIRGATSHYDYVCNEVAKGVSKANDISDTPVIFGVLTTESIEQAVERAGTKAGNKGSEAAVSAIEMANLIKQIN

SEQ ID NO: 5104 - protein, 165 aa, Staphylococcus epidermidis
RNTKTTSLFKFIYKGLTSMKCISTHSLLYIQTAFSTNVETYIQYEHYAIHLPCTPEKTLHYLLELHQKSYHNQCMLSKNILNIKKFIPIYINEETILFPVTQKRAPIKYFINARNIIGIHSSIHTTMIVFEDGTTIELNIPYTLVTKKWQRNLTVGHIIKKTTFY

SEQ ID NO: 5105 - protein, 835 aa, Staphylococcus epidermidis
LLANKGGNAAQVVPFKSLIVEMSFYELGGNVLNYNHKEIEKKWQNYWEENKTFKTNDNLGQKKFYALDMFPYPSGAGLHVGHPEGYTATDIISRYKRMQGYNVLHPMGWDAFGLPAEQYALDTGNDPREFTQKNIQTFKRQIQELGFSYDWDREVNTTDPEYYKWTQWIFIQLYNKGLAYVDEVAVNWCPALGTVLSNEEVVDGVSERGGHPVYRKPMKQWVLKITEYADRLLEDLDELDWPESIKDMQRNWIGRSEGAKVTFKIEQSDQNIEVFTTRPDTIYGTSFLVLSPEHPLVNEITTSDKEQEVKLYQNEASKKSDLERTDLAKEKTGVFTGTFAINPLSGDKLPIWIADYVLSTYGTGAVMAVPGHDERDHEFATKFNLPIIEVIEGGEVQKYAYTGEGKHINSRELDGLENEAAISKAIELLESKGAGEKKVNYKLRDWLFSRQRYWGEPIPIIHWEDGSMTTVPEDELPLLLPETDEIKPSGTGESPLANIDAFVNVIDEKTGMKGRRETNTMPQWAGSCWYYLRYIDPHNEKMIADPEKLKHWLPVDLYIGGVEHAVLHLLYARFWHKVLYDLGVVPTKEPFQKLYNQGMILGEGNEKMSKSKGNVINPDDIVASHGADTLRLYEMFMGPLDAAIAWSEKGLDGSRRFLDRVWRLIITDENSINKKIVDSNNHSLDKVYNQTVKKVTEDFDTLSFNTAISQLMVFINECYKTNEVYKPYIEGFVKMLSPIAPHIGEELWDRLGHENTITYQPWPTFDESLLVDDEVEIVVQVNGKVRAKINIPKDLSKEEMQDLALSNDNVKMSIEGKEVKKVIAVPQKLVNIVAK

SEQ ID NO: 5106 - protein, 1177 aa, Staphylococcus epidermidis
IIKKGSVIMSWFDKLFGDDNGSNDDLLRKNKNRRQSQQSKQNNQDSLLPQNNDIYSRPRGKFRFPIQVSENEYTQKNENYNEHNQEETNDIMRSYNQHDNPEFDSSGKRHRRRRQAYSKHDQSKITQQKQFADNNYTNNNSVFNQNDNKKSSQQRKSIQSENIKNKANTKNTSTSPEFTYLNHSFKSSEVPSAIFGTKKRRPIENGVIPPEHKELNDKEIVQQDEVSHSTKSIDASKNVSNSNDNNIEKNQQKKQQTTAQTESSSENMHNVEKSNYQTTKRKTPNYSKVDNTINIENIYASQIVEEIRRERERKVLQKRRFKKALQQKRQQNQQSEEDSIQKAIDEMYAKQAQHYTGESSLDLENESNQDSSSNSLEKQSNSSNIDNKEAQNNTPLFNYEEIDLDTTSDVYKVNEEETESKNDEDLVSSNHYHSNDDAEVEDAEYHELDDNRQQNQSNSQDDIISSKSSTSNMYDNAISASVDNNTERAKSNEDKNDTEITHLDGTTSAKVSDEKIESNTNNHLEQDKNVKLKNVNSLKSSNSDTGQTRKQRFGGSRPFNVLMTPSDKKRMMDQNHKKVSVPELKPEKQANANHRKDSESNKSEEFKQINTNRETDSNSYESNGIEHDMNSSSDEHVYETPSKQQDEQIQKLQDDFHFENANHAKINNSNETGNQSNISHSKRSQYSTNESKNIDTQTSNSSTSNQNFQRIRKGPNIKLPSYQLLEAPEPHEKDQDWIDNKKQELNDALYYFNVPAEVKNVTEGPSVTRFELSVEKGVKVSRITALQDDIKMALAAKDIRIEAPIPGTSLVGIEVPNQNPTKVNLRSIIESPKFKNTESKLTVAMGYRINNEPLLMDIAKTPHALIAGATGSGKSVCINSILMSLLYKNHPEELRLLLIDPKMVELAPYNDLPHLVSPVITDVKAATQSLKWAVEEMEKRYKLFAQYHVRNITAFNKKAPYEQRMPKIVIVIDELADLMMMAPQDVEQSIARIAQKARACGIHMLVATQRPSVNVITGLIKANIPTRIAFMVSSSVDSRTILDSGGAERLLGYGDMLYLGSGMNKPIRVQGTFVSDDEIDEVVDFIKQQRDPEYLFEEKELLKKTQTQAQDDLFDDVCEFMVEEGHISTSLIQRHFQIGYNRAARIIDQLEQLGYISGANGSKPRDVYITEADLSKE

SEQ ID NO: 5107 - protein, 276 aa, Staphylococcus epidermidis
KMWKWETENDAKGVVVIAHNILEHTGRYAYVITMFRRNGYHVIMGDLPGQGQTSRAQKGQIDDFNTYHENILEWIKIANEYKIPTFVLGVGLGGLIILNLLEKTELPIEGILLFSPMLELKRDYKGCKNKLISNVGKISKDTRFKVGITPQDLTRNDEIIEETANDGLMLKKVTYSWYNLINEKMKETMDHIRDIKPISALIMYGTNDKILETQSINEMKDKLKSKEMYFKVWDGLYHEIHNEPERDLVMRYVLSFLNNSVNTMGFIVNEEEIEDI

SEQ ID NO: 5108 - protein, 73 aa, Staphylococcus epidermidis
NDDLPLVIVRHSRFVPVQELVQVLIIKVGNTALYIPPIIRFIYFSKNSEYLKPLLYSYHIIKTFTCLKFVIAI

SEQ ID NO: 5109 - protein, 554 aa, Staphylococcus epidermidis
VMSESKEMVRGTFLITISILITKVLGVLFIIPFTALIGGQANMAPFTYAYAPYNIAIAIATAGVPLAASKYVAKYNALGAYKVSQKFYKSSFVVMSITGIVGFLVLYLLAPYIAELTLSRNTHGNSGWTVADITWIIRIISMVVIFIPVLATWRGIFQGYKSMGPTAVSEVTEQIARIVFILVGSYLTLNVFGGTVLQANGIATFAAAIGAIAGILTLWYYWIKRRKNIKKMVDSDTANLNVSYGKMYKEIIAYSIPFVIVSLNFPLFNLVDQFTHNGALNLVGVKPGLQDIFFNMLNMSTNKIVMIPTSLSAGFAVSLIPFITKTYEEGRYAEMHRQIRTSIGVLMFITVPASIGIMALAQPLFTVFYGFDPVVHGHDPNFDGSRLLFYYAPVAILISLLSVTASMLQGIDKQKLTVFVILGSVLIKLILNYPLIMLLHTPGAVLSTAIALLFAICCNFYILKKYANFKFSYSWIHLAKIILISIIMMIGVEVIFFILRLFLEPTRFNYLIIVAIGVIVGAIIYGGITIKTKLADEFLGDIPAKIRRKVKMLR

SEQ ID NO: 5110 - protein, 85 aa, Staphylococcus epidermidis
MTLDMPASMILSTQGGVEPWCVQGSNETYMVAPWVFKPAISIACTSACLSPFFKCAPKPTILPFLTTTDPTGGLTPVCPFTIFAN

SEQ ID NO: 5111 - protein, 413 aa, Staphylococcus epidermidis
QMSEQEKNQHHYRNSSQKRHTFPWIKTIIVAIIAGIIGALLVLGIGKLLNKTGFNNEGATVHQVSNSHGGNQLDGKSNQYKSVHDMIKDVSPAIVGVINMQKSTNLDDLFNGKASKSKEAGIGSGVIYQISDGSAYIVTNNHVVDGASEIKVQLHNSKQVDAKLIGKDALTDIAVLKIKDTKGIKAIQFANSSKVQTGDSVFAMGNPLGLEFANSVTSGIISASERTIDANTSAGNTKVNVLQTDAAINPGNSGGALVDINGNLVGINSMKIAAAQVEGIGFAIPSNEVRVTIEQLVKHGKIERPSIGIGLINLSDIPENYRKELHTHKDKGVYVAKVDSENAIKKGDIITGIDGKQIKDDTDLRTYLYESKKPGEMVTLKVIRDGKTQDINVKLKKQASASESSQSQSQFAQ

SEQ ID NO: 5112 - protein, 263 aa, Staphylococcus epidermidis
KHLDFIKEKRMPIEYETHFFNEVTYLVDYLKVKALMMIPKNKKDIKRIVIYLRGGKGQVGRVRAARLMQFANEYTLVIGPYYRGNNGSEGRDEFYRGDLNDVTHLIRLLNQNYPSAFIHMVGFSRGGLQGLLTFNDLPVDSYMIWGGVSDIHLMYEERVDLRGMLRRMVGHPKKDAKAYKSRDAMQFIKKDSPPILIIHGGKDIQVGIHQAYDLEKKLKSKGIYYQTYYQLDEGHVPRPPAMRDVIRYIHQWMNDVENKNLNI

SEQ ID NO: 5113 - protein, 427 aa, Staphylococcus epidermidis
KGMEVIIMYQTIVIGGGPSGAMAAVAASEKNKSVLLIEKKKGLGRKLKISGGGRCNVTNRLPYDEIIKNIPGNGKFLYSPFSVFDNLSIINFFETRGVKLKEEDHGRMFPVSNKSQDVVDVLINQLKENHVEVKEETPVVSVSYDHNFKVKTQIGEFESHSLIIATGGTSVPQTGSTGDGYKFAKSLGHSITELFPTEVPITSSETFIKSNRLKGLSLKDVNLSVLKKNGKKRVSHQMDMIFTHFGISGPAALRCSQFVYKEQKNQKKKNIHMQLDVFPELNVDQLSQKVRKILNAEPDKYIKNSLRGLIEERYLLFILEQSGINDEMTAHHLSNQQFQTFINLLKTFTFTVDGTLPLDKAFVTGGGISLKEIEPKTMMSKLVPGLFLCGEVLDIHGYTGGYNITSALVTGHVAGMFAGEFKIDQNK

SEQ ID NO: 5114 - protein, 497 aa, Staphylococcus epidermidis
AQLLIFNKQVGIIIRVYNLEECIVNFWLQEQAQSNGNRLAIVTNQLSLTYEELYHRAKTIAEYLTSLNQKRIGLYISNDIDSVVLIHACWLAHIEIAMINTRLTRHEMINQMNSVDIATIVHTLPLELEGFNLYHFNDLTQLDKHDVSGYKFNLESIASIMFTSGTTGPQKAVPQTFNNHLASAKGCKQSLGFEQNTVWLSVLPIYHISGLSVILRAVIEGFTVRLVKKFQTDDMLTQIKTYPITHMSLVPQTLKWLMDAGLTQPFSLEKILLGGAKLSPQLIEQALTYRLPVYNSFGMTETCSQFLTASPQMLKERFDTVGKPSENVEVKIKNPNAYGHGELLIKGENVMNGYLYPKYLKDTFDNDGYFQTGDIAEIDDEGYVIIYDRRKDLIISGGENIYPYQIETIAKDFEGIEDAVCVGISDDTWGQVPILYYVTNQDINQTELIEHFENHLARYKIPKKYYQVKSLPYTSTGKLQRKKVKSEDLNEGKNNES

SEQ ID NO: 5115 - protein, 123 aa, Staphylococcus epidermidis
PIGFSTIDFPFSITICNIRFGFNFRFFNQLSSLCFFFICCIVVTIDDCNLLLSFFINSRFCICFNCCCWYYGSNLIHAVIFSIINLIISLRLIDICYSFIFTNLKKSFGFIFFFISCIFVIIN

SEQ ID NO: 5116 - protein, 490 aa, Staphylococcus epidermidis
MYKLLQHLGRSLMLPVAVLPAAAIIVGIGHVLDALNILPQAALFFTSVGTTILEQLGILFAIGVAIGMAKKNDGAVALAAALGFFIVTVVLSPEKLATLLQIKESKIDLAFSQMNNGNVFVGIIIGLIAAYSYNKFSETNLPMALSFFSGKRLVPIMTAFFCTILAIILLLIWPPVYNGIVTFGKWIVGMGPFGALLYGFFNRLLIPTGLHHALNNVFWFDTAGINDIGKFQSGKNAIKGITGRYQAGFFPVMMFGVPAAALAMYHTAKTNQKKQVYAWFLASSVSAFFVGVTEPIEFAFMFVAPVLFVIHAVLTGLSLFIAAMFHWTAGFSFSAGLIDYVLSLVNPISNQPWMLLLQGVVFFIIYYVIFRVVIQVFNLSTIGRGDNELIDPTSNDTSEMEVLQNKTTTSKYYQNAKRILDGLGGKENIISLNHCATRLRLELKDNSIIDEQKIKNAGAIGITQNGHHYTQVIIGTHVQQVANEMDHQMN

SEQ ID NO: 5117 - protein, 91 aa, Staphylococcus epidermidis
IFSWRPLSMLKKILLSLVVFYQRFISPLTPPTCRFYPTCSQYTREAIEYHGALKGLYLGVRRILKCHPLHKGGFDPVPLKKDKNSKTTHHH

SEQ ID NO: 5118 - protein, 539 aa, Staphylococcus epidermidis
LNLWRLLDMSHKILVSDPISEDGLQSILKHPEFDVDIQTDLSENDLVNMISTYDALIVRSQTQVTERIINAATNLKVIARAGVGVDNINIEAATLKGILVINAPDGNTISATEHSVAMLLAMARNIPQAHQSLRNKEWNRKAFRGVELYGKTLGVIGAGRIGLGVAKRAQSFGMKILAFDPYLTEDKAKSLDIQIATVDEIAEKSDFVTVHTPLTPKTRGIVGSSFFNKAKQNLQIINVARGGIIDETALIEALDNNLIDRAAIDVFEHEPPTDSPLIQHDKIIVTPHLGASTVEAQEKVAVSVSEEIIEILTKGNVEHAVNAPKMDLSKVDKTTQSFIGLSTTIGEFAIQLLDGAPSEIKVKYAGDLAQNDTSLITRTIITNILKEDLGNEVNIINALAILNQQGVTYNIEKQKKHSGFSSYIELELVNDQDKIKIGATVFAGFGPRIVRINDYSLDFKPNQYQLVTCHKDKPGIVGQTGNLLGSHGINIASMTLGRNDAGGDALMILSIDQQASEEVIKILNETSGFNKIISTKLTI

SEQ ID NO: 5119 - protein, 395 aa, Staphylococcus epidermidis
ILLWEECTMQYYQPLLLTPGPTPVPEQILSAVQLPMVGHRSTDFEEIASEAFKGLKPVFGSKNEVLILTSSGTSVLEASMLNIANPDDHIVIIVSGAFGNRFKQIAQTYYNHVHVYDVNWGEAVIVDDFITYLKQLNVPVTAVFTQFCETSTGVIHPVHQLGHALKAFDNSLYFIVDGVSCIGAVDVDLTKDKIDVLVSGSQKAIMLPPGLAFVAYSDRAKKRFADVKTPRFYLDLNKYIKSQEQNSTPFTPNVGLFRGINAYVELVKKEGLNHVISRHFKIRNALRAALKALELELLVKDDAHASPTVTSFVPKNQEELNIIKNQLKSQFNITIAGGQGHLKGQILRIGHMGKISPFDILAVVSALEIILTSNRNVNYIGTGITQFMEVIRHES

SEQ ID NO: 5120 - protein, 322 aa, Staphylococcus epidermidis
KGKCIMGNYFPYAFEDKRYHTWNYHLKNKFGQKIFKVALDGGFDCPNRDGTVAHGGCTFCSAAGSGDFAGNRAEPIEVQFKKIKERMHEKWSEGQYIAYFQAFTNTHAPVEVLKEKYEPVLKEDGVVGLSIATRPDCLPDDVVEYLAELNQRTYLWVELGLQTVHQSTSDLINRAHDMQTYYDGVTKLRKHNINVCTHIINGLPGENYDMMMETAKEVAQMDVQGIKIHLLHLLKGTPMVKQYEKGMLEFMSQQDYTNLVCDQLEVLPPEMIVHRITGDGPIDLMVGPMWSVNKWEVLNEIDNELARRNSYQGKMNKQSIQS

SEQ ID NO: 5121 - protein, 66 aa, Staphylococcus epidermidis
GIFRAIASNIATECSVAEIVLPSGALITKIPFKVAASILILSTPTPALAMTFKFVAALIIRSVTWV

SEQ ID NO: 5122 - protein, 74 aa, Staphylococcus epidermidis
IGMLLYNYVPQNKWSQWFKTYGVEESVNLNKRMKWYTVIQAIGLIQWYEEQKRYRDMNTWLKFLNEVMNSNLFI

SEQ ID NO: 5123 - protein, 109 aa, Staphylococcus epidermidis
CLSRRQFMARSKKYFYLSLLMIILSFFFNTNNSLLSNIFQSFMKIVVVTSIVNIIILILSIVFADKSIKYAKESSDWIRFASKILPLIILITIIIHILSSLHTFGYIFK

SEQ ID NO: 5124 - protein, 139 aa, Staphylococcus epidermidis
KTYSRKANEIILATRVENLLSKDEIIYTYLNIVPFGHDYNGANITGISSASYSLFGIPAKDLNIAQSAYLIGLLQSPYGYTPYDEHGKVKPYHLLKLSMKRQQYVLKRMRVEGKISKQQYENAKKYNIKQHLLKQSKDE

SEQ ID NO: 5125 - protein, 446 aa, Staphylococcus epidermidis
QSIRDDSKATADAPVGPGPREALDYMYNLGKRDGFSTHDVDHIAGRIEAGKGEDVLGILCHVDVVPAGDGWDSNPFQPVVTDNAIIARGTLDDKGPTIAAYYAVKILNEMKVDWKKRIHIIIGTDEESDWKCTDRYFKTEEMPTLGFAPDAEFPAIHGEKGITTFDLVQNEVTEDTDEPDYELLKFESGQRYNMVPDYAKAEVLVKENMTDVIQNFENFLQQNQLQGESTVDSGILILTIEGKAVHGMDPSLGVNAGLFLLKFLASLNLNKSAKDFVEFNERYLFESHFGEKMGMKFHTDIMGDVTTNIGVISYDKEKAGSYGINLRYPEGFKFEDAIDRFRSEINELGFNLELGKVQKPHYVDKNDPFVKTLVNAYRNQTGDMTEPYTIGGGTYARNLDKGVAFGAMFADSEDLMHQKNEYITKKQLINATSIYLEAIYALCVED

SEQ ID NO: 5126 - protein, 209 aa, Staphylococcus epidermidis
  UNSURE (206): Identity of amino acid at the above locations are unknown.
NIWLTKNYFLSHFLVESEVNVLEQFYQLGWTLDSAGGASGEAYMAEQDGQKLFLKRNSNPFIAALSAEGIVPKLVWTKRIETGEVVTAQHWKNGRELNEDEMNQTRVAELLHKIHGSRPLLTMLKRMEMEPITPDIMLNKINASLSREVLTHHVVRRALTYLEDHLPNLEPRFFTVVHGRVKHNNWLLSESDELYLVDWGRCMIAXPAN

SEQ ID NO: 5127 - protein, 71 aa, Staphylococcus epidermidis
VLKSERLNAPILPIKKAPNKFATNVPNGMVEPSLSIDKQNLINAPKAPPTKIYRYCIYISPQNIKELIIII

SEQ ID NO: 5128 - protein, 338 aa, Staphylococcus epidermidis
MRERIMKVKAINLYTYKEPFKSPISTPKVKLTHRESLFTEIVTYSGETYYGECNAFLTNWYDKETILTVVNRLRQWIPQVLHKDMTSFDSWLPYLNQMNDVPAARSMVVMAVYQMYNDLHDFEVQYGATVSGLTNSQIETLLETRPKRIKLKWSTSLIKDLETIRLLNFDCDIAIDANESLTKPSFLQLANVNTSDIIYIEEPFKILEDLNDIDMSIFPRIAIDEKALSIEKIQSIIQQYPIQVVVLKPFRLGGIDRMLNAMKILKEKNIRFVVGGMYEFGLSRYFTAMLAKEGSYPGDITPHGYYFSNDIVETSGILKGGMIYFTPPKVKRSLLNKV

SEQ ID NO: 5129 - protein, 217 aa, Staphylococcus epidermidis
LMMRVRYKPWAEDYLKNHPDLVDMDGAHAGKMSEWFEKEQPIYIEIGSGMGQFITTLAAQYPEINFVSMEREKSVMYKVLDKTKEMGLKNLKMICNDAIELNEYFKDKEISRIYLNFSDPWPKKRHAKRRLTYHTYLALYKQILKDDGEIHFKTDNRGLFAFSIESMSQFGMYFTKMNLNLHDEDDEDNIVTEYEKKFSEKGSRIYRMEAKFHKCFE

SEQ ID NO: 5130 - protein, 160 aa, Staphylococcus epidermidis
EEVRNVEFEDKDGRIVTLNYKNENDMPNGNHVLAIPVYNNQLLFTNHQHRGIEFPGGKVEISEQSKEAVIRELYEETGAIAKFIYYFAQYSIKMEHDEPFIKDVYFVEVSHLEYVDTYYETLGPCLYHQINDIPLNKRSFLINDKAILHCLERVKTLGFY

SEQ ID NO: 5131 - protein, 153 aa, Staphylococcus epidermidis
LNWRSIHMVRHDFKVKTEWLGGREEVGKLRGDIINENISIPSSLGGQGEGTNPDELLVSAASSCYIISLAATLEKSGFTNVKINQQSIGTASFENKKFKMERITHYPSIKVPSSQTEKLKSILDKLLVIADNNCMISNAIRNNVIISIEPNLI

SEQ ID NO: 5132 - protein, 116 aa, Staphylococcus epidermidis
TNDMNYVRGEFVMKSVNFKKITILFFSTAFLILIFSLIFLTKKKLYNAELLLNEVKTYFREVKGSYIVQEPIVLENINHNQPIYQGGITVLKNDHLINYEFYADAVSGQIIDIIEL

SEQ ID NO: 5133 - protein, 442 aa, Staphylococcus epidermidis
VRSIEMTHYHFVGIKGSGMSSLAQIMHDLGHEVQGSDIESYVFTEVALRNKGIKILPFDANNITKEMVVIQGNAFPDNHEEIVRAHELKLDIIKYHDFLGHVINQYTSVAVTGAHGKTSTTGLLSHVMNGDKKTSFLIGDGTGMGLPGSDYFAFEACEYRRHFLSYHPDYAIMTNIDFDHPDYFKNIDDVYDAFQHMALNVKKGIIAWGDDEYLRKLDVDIPVYYYGFKETDDIYAKNIQITEKGTQFDVYIKGEFYDQFLSPQYGNHNILNALAVIAISYLENMNVENIKEALITFGGVKRRFNETKVSNQVIVDDYAHHPREISATIETARKKYPQKDVVAVFQPHTFSRTQAFLNEFAESLSKADQVFLCEIFGSIRENTGDLTIEDLINRIDGSTLIDENSIDVLEKFDNAVILFMGAGDIQKLLKAYFEKLGVKNDF

SEQ ID NO: 5134 - protein, 65 aa, Staphylococcus epidermidis
LFFITKFYSVNLVTLNIISYSLNSLYSYWNVRMSEFCSFIYFPSIYSLLFGEISRKKYLTISVLI

SEQ ID NO: 5135 - protein, 79 aa, Staphylococcus epidermidis
LGFITSKKDMDYITKNINSFTKRLAEAINGRQINALKSNPSSKKITWNWGGTFYPNAPKSGIRVRRSLGINGAIVESGS

SEQ ID NO: 5136 - protein, 211 aa, Staphylococcus epidermidis
AGDIMYNFISKILDVILVKMSKSLYVIGKENIPKDSKYVVTCTHESYNEVIMLGMALLPNQIHYMAKKELFKNQWAGKFLKSLNAFPVDRENPGPSTLKKPVNLLKEHKTIGIFPTGHRTSVEGAPLKRGAATIAMLGKAPILPAAYVGPKKIHGLITGQALIKIGKPIEMDDIPKDLKRNEKVDFLTKEIERRTTQLQKELNEISCSLKK

SEQ ID NO: 5137 - protein, 288 aa, Staphylococcus epidermidis
GVLIMNVFQMRDKLKARLKHLDVEFKFDREEETLRIVRIDNHKGVTIKLNAIVAKYEEQKEKIIDEICYYVEEAIAQMGDEVINNVEDIQIMPVIRATSFDKETKEGHAFVLTEHTAETNIYYALDLGKSYRLIDENMLQTLNLTAQQVKEMSLFNVRKLECRYSTDEVKGNIFYFINTNDGYDASRILNTSFLNHIQHQCEGEMLVGVPHQDVLILADIRNKTGYDVMAHLTMEFFTKGLVPITSLSFGYDNGHLEPIFILGKNNKQKRDPNVIQRLEANRKKFKKD

SEQ ID NO: 5138 - protein, 103 aa, Staphylococcus epidermidis
MESITVDELKKKILDSNPVNIVDVRTNEETEMGVIPGAKTIPMDEIPDNLKEFNKNDTYYIVCAAGSRSAKVVSYLEEQGVHAVNVEGGMNAWGDEGTVIDNI

SEQ ID NO: 5139 - protein, 564 aa, Staphylococcus epidermidis
LYKIKGLNILAQLSDLEIANLSKLKPISEIARKVGITEDALEPYGHYKAKIDINQIQEQKKKGKVVLVTAMSPTPAGEGKSTVTVGLADAFNKLNHNVTVALREPALGPTFGIKGSATGGGYAQVLPMEDINLHFNGDFHAITTANNALSAFIDNHLHQGNELGIDQRRIEWKRVLDMNDRALRHVNVGLGGTTHGVPREDGFNITVASEIMAILCLSRNIKDLKEKISRITIGYTRHHKPITVSDLKVEGALTLILKDAIKPNLVQTIEGTPALVHGGPFANIAHGCNSILATETARNLSDIVVTEAGFGSDLGAEKFMNIKAREAGFDPSAVVVVATIRALKMHGGVAKDQLQHENIEAVEAGLVNLERHVNNIKKYGVEPIVALNAFIHDTPSETACVKQWAKDNQVRIALTEVWEKGGEGGIELANQVFDVMQKPQNFKHLYELKQPLEAKIETIVKEIYGGSKVNFSSKTQKQLKQFKENGWDEYPICMAKTQYSFSDDQTLLGAPNDFEITIRELEAKTGAGFIVALTGAIMTMPGLPKKPAALNMDVTDDGKAIGLF

SEQ ID NO: 5140 - protein, 119 aa, Staphylococcus epidermidis
IFLITILLVMLGGGIGAVLRALITNICQRLFNSKIPIATSIVNITGSLIIGFMMGHALDSHHMFPFFVTGVLGGLTTFSTLSSELVNMLSPQFKPIRFVVYSLLQFILGFIACFYGYRI

SEQ ID NO: 5141 - protein, 427 aa, Staphylococcus epidermidis
FRRILSMANALIEDLKWRGLIYQQTDEEGIEELLNKEQVTLYCGADPTADSLHIGHLLPFLTLRRFQEHGHRPIVLIGGGTGMIGDPSGKSEERVLQTESQVEANVKGLSNQMHRLFEFGSDKGAKLVNNKDWLGQISLISFLRDYGKHVGVNYMLGKDSIQTRLEHGISYTEFTYTILQAIDFGYLNRELNCKIQVGGSDQWGNITSGIELMRRMYGQTEAYGLTIPLVTKSDGKKFGKSESGAVWLDPEKTSPYEFYQFWINQSDEDVIKFLKYFTFLEKEEINRLEQSKNEAPHLREAQKALAENVTKFIHGEAALKDAIRISKALFSGDLKSLSAKELKEGFKDVPQVTLSTKTTNIVEALIETGIASSKRQAREDVNNGAIYINGERQQSVDYELSSKDLIEDEITIIRRGKKKYFMVNYQS

SEQ ID NO: 5142 - protein, 235 aa, Staphylococcus epidermidis
TCYFSSNRYTGGRFMQQETTSWYKQEWFIVLSLLFIFPLGLFLMWKFSKWPSIARTIITVAISVIVLASITYYGNLQMIVPATSNSNNETKETTENNVNDKDERNHKTAVEETKTNYDSTKENTKEPGKENESATRLENSALEKAKSYYDDFHMSKLGIYDILTSEYGEKFDKEDAQYAIDHLEADYEKNALEKAKSYAKDMHMSNDSIYDLLVSNYGEKFTESEAKYAIEHLDN

SEQ ID NO: 5143 - protein, 427 aa, Staphylococcus epidermidis
QMHLNEAFTYLSAFVLGGKFMEHYNRDNFEKSHTSEELYHRTSRSQSNSLKRKDFVVSFIASAIVGSAVGLYYKNKIYKKTDELKEKEQDLRSKVENYRQRAEDTVVSVKSKVEQLKYDSKDNIHADELQAQKAAIQRETDLADESPEAQAIQEAKKETKQVDDVRPSATELAAQQNAIQHETDLADESPEAQAIQEAKSEVDSNNKTSTTHIDSEKEPSAEEIAIAQTAVKEEARNHDLANLSASGEDTKSKSETETEKLAAAAKAKKDRINNNNEVASNTKNLMQEEAIKASNNSDVPNLVTNLNQSQASDTNSVAYRLAQAAKEKRSKLTNGSKETQLTEALLKEPSIAKAQTKLKRIPTLITESKKHSNNPHSQKNSNQTKNITATKEDSKGKQQHTPNQNKRNKQQKVEKTSSKIEKRTFND

SEQ ID NO: 5144 - protein, 307 aa, Staphylococcus epidermidis
RSVVLMDFSSPTVIGLIVAILVAVLFFILFLIANHSKKKVKNQTEAHYKEKEQHLKESHEEALEKERVENKKVVTKQKEDFDVTVSNKNREIDALKLFSKNHSEYVTDMRLIGIRERLVNEKRIRPEDMHIMANIFLPSNELTNIERVSHLVLTRTGLYIIDSQLLKGHVYNGISGAQFKELPTMSQVFDTLDLDSSQPQTLVLDQNEDQHSLSFVNYSDKIKHIEKLAGDLQNELNTKYTPTSILYFNPKKDNDVTISHYTQSSNVKVLVGPEQLDEFFNKFVFHGRIQYNVDDLQDIMVKIESFN

SEQ ID NO: 5145 - protein, 235 aa, Staphylococcus epidermidis
SEDVAMRLDKFLANMGVGTRSEVKQLLKKGSVKVNQNIVKLPKLHVNPNSDEIMVNDEVVSYIDKVYIMLNKPKGYISATEDEVHPTIIDLIPEYAHLNIFPVGRLDKDTEGLLLVTNDGQFNHEVMNPNKHVSKTYEVYSKHPITQFDIDKFKSGIELSDGKLKPAILKKVDNYVSHVTIYEGKYHQVKRMFHSIENEVLELKRIKIAQLELDHNLDLGSYRLLTQIDFDNLKN

SEQ ID NO: 5146 - protein, 62 aa, Staphylococcus epidermidis
FLCVYYHFVDVDIKILTILLKGMFFILAEICNSLFKTFCICFISFIAIEMILLADFVIVLLK

SEQ ID NO: 5147 - protein, 136 aa, Staphylococcus epidermidis
RLFFCTSLAKRKYYSFNKWTNSTITIWKGILIFMIKLESEQQFEELKKGYTVFEFTAGWCPDCKVIEPDLPKLEKKYSQLQFVSVDRDQFIDICVQNDILGIPSFLIFKEGQLLGSYIGKERKSIDQIDQFLSQHI

SEQ ID NO: 5148 - protein, 188 aa, Staphylococcus epidermidis
MNLFYNPKGVGDVAFIQIEPSVGPFEYEQKHGVVEIKKENEVVGYNIFNVSNNVTINDNGHIKLTTELIKDLQQLITEAGFDYQLDTDVSPKFVVGYVKTKEKHPNADKLSVLNVNVGTEKLQIVCGAPNVKSGQKVVVAKVGAVMPSGMVIKDAQLRGVDSSGMICSMKELNLPNAPKEKGIMGTNR

SEQ ID NO: 5149 - protein, 369 aa, Staphylococcus epidermidis
KYSLSVQTLYVNAFLNLIFMIHYLKISYSSITEVLHMSLFKDFFIALSNHTYLNKIAKKMGPQMGANRVVAGNTIHQLIETIQYLNDYNISVTVDSLGEFVNTREESIKAKEEILEIIDAIYNNNVKAHMSVKISQLGSEFDLNLAYENMREILLKADKNGKMHINIDTEKYDSLSKIQHIIDRLKGEFKNVGTVVQAYLYEADDIIDKYPELRLRLVKGAYKEDASIAFQSKKEIDANYIRIIKKRLLNSKNFTSVATHDNEIINQVKQFMKENHISKDKMEFQMLYGFRTELAQKIANEGYFFTVYVPYGNDWFAYFMRRLAERPQNLSLAIKEFTKPKILKKATLGIGIFATLLTSLILGIKRHKK

SEQ ID NO: 5150 - protein, 350 aa, Staphylococcus epidermidis
GDQLSRFMDDAIQLAKMVNGQTGVNPPVGSVVVKNGRIVGLGAHLKKGDKHAEVQAIEMAGLNTQGATIYVSLEPCTHHGSTPPCVDKIIEAGISKVIYAVKDTTLVSKGDEILREAGIEVEFQYNENAAALYRDFFTAKRNEVPEVTVKVSSSLDGKQATDFNESKWITNKEVKEDVYQLRHEHDAVITGRRTIEADNPLYTTRVPDGKHPIRVILSKKGQLDFNQQIFKDTASEIWIYTENEKLKTNKSFIKIINISNCDTTTILQDLYQRGIGKLLVEAGPNITSQFLQSKHLNELILYIAPKLIGGSGKHQFYKTDEVIDLPEATQFEIVDSKLINQNLKLKLRKK

SEQ ID NO: 5151 - protein, 149 aa, Staphylococcus epidermidis
NSQFFIWEMLILANSEKNRVYGILQLKTLFKKIDSIFNTIKKKYGMSKEEILILLTLLEKGSMTLKEMDKYVHIKPYKRTRTYNNLVNLEWIYKERPQDDERTVIIHFNDKQNSKKEDLLKFIDDSIKIKSEPMQSILQSILAVEFNVL

SEQ ID NO: 5152 - protein, 63 aa, Staphylococcus epidermidis
MNSSTSLFSMDAYSTMWMIYKISWLKSSHSIKLLKKYFIFHMSAYYSLQNNYYKLIVLKAFLI

SEQ ID NO: 5153 - protein, 304 aa, Staphylococcus epidermidis
IGLPVAEGRLSIRNCPGKISNTSYQTFIKDTQLYSLKNDEAIILVSLPFNASWLNQRYSEIMQAIIYDVIGYEVKPHFISEDELASYNNVNTQEVQEPQVQHSSIDDKTWGKEQFNMHNTFDTFVIGPGNRFPHAASLAVAEAPAEAYNPLFIYGGVGLGKTHLMHAIGHHVLSNKPNAKVIYTSSEKFTNEFIKSIRDNETEAFREKYRKIDVLLIDDIQFIQNKEQTQEEFFHTFNELHQNNKQIVISSDRPPKEIAKLEDRLRSRFEWGLIVDITPPDYKTRMAILQKKLKKKILIFRQKL

SEQ ID NO: 5154 - protein, 242 aa, Staphylococcus epidermidis
FYYFIGETGADNMTHLTFKQGVKECIPTLLGYAGVGLSFGIVAASQNFSVLEIILLCLIIYAGAAQFIICTLVIAGTPISAIVLTTLIVNSRMFLLSMTLAPNYKQYGFWNRVGLGTLLTDETFGVAITPYVKGEKINDRWLHGLNITAYLFWTVSCVIGAIFGEYISNPDALGLDFAITAMFIFLCISQFEGIKKSRLRIYIVLIVCVIVMMLLLSSILPSYVAILIAAIVAALLGVVMEK

SEQ ID NO: 5155 - protein, 338 aa, Staphylococcus epidermidis
SHHQMKRGVTILNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 5156 - protein, 468 aa, Staphylococcus epidermidis
IGWQRVDHVPCLGCGLFLLFYHTKSSIKLNIFYLGKDEGYMLDIRLFRNEPEKVKSKIELRGDDPKVVDQVLELDEQRRELISKTEEMKAKRNKVSEEIAQKKRNKEDADDVIAEMRHLGDEIKDIDNQLNEVDNKIRDILIRIPNLINEDVPQGDSDEENVEVKKWGTPRDFEFEPKAHWDLVEELKMADFERAAKVSGARFVYLTKDGALLERALMNYMLTKHTTQHGYTEMMTPQLVNADTMFGTGQLPKFEEDLFKVEKEGLYTIPTAEVPLTNFYRDEIIQPGVLPELFTAQTACFRSEAGSAGRDTRGLIRLHQFDKVEMVRIVQPEDSWNALEEMTQNAEAILEELGLPYRRVILCTGDIGFSASKTYDLEVWLPSYNDYKEISSCSNCTDFQARRANIRFKRDAASKPELVHTLNGSGLAVGRTFAAIVENYQNEDGTLTIPEALVPFMGGKTKIEKPIK

SEQ ID NO: 5157 - protein, 902 aa, Staphylococcus epidermidis
TELLKEDLLMAELPQSRINERNITSEMRESFLDYAMSVIVSRALPDVRDGLKPVHRRILYGLNEQGMTPDKPYKKSARIVGDVMGKYHPHGDSSIYEAMVRMAQDFSYRYPLVDGQGNFGSMDGDGAAAMRYTEARMTKITLELLRDINKDTIDFIDNYDGNEREPSVLPARFPNLLVNGAAGIAVGMATNIPPHNLTEVIDGVLSLSKNPDITINELMEDIQGPDFPTAGLVLGKSGIRRAYETGRGSIQMRSRAEIEERGGGRQRIVVTEIPFQVNKARMIEKIAELVRDKKIDGITDLRDETSLRTGVRVVIDVRKDANASVILNNLYKQTPLQTSFGVNMIALVNGRPKLINLKEALIHYLEHQKTVVRRRTEYNLKKARDRAHILEGLRIALDHIDEIITTIRESDTDKIAMASLQERFKLTERQAQAILDMRLRRLTGLERDKIESEYNELLEYIKELEEILADEEVLLQLVRDELTEIKERFGDERRTEIQLGGLEDLEDEDLIPEEQIVITLSHNNYIKRLPVSTYRSQNRGGRGIQGMNTLDEDFVSQLVTMSTHDHVLFFTNKGRVYKLKGYEVPELSRQSKGIPIINAIELENDETISTMIAVKDLESEEDYLVFATKQGIVKRSSLSNFSRINKNGKIAINFKEDDELIAVRLTTGNEDILIGTAHASLIRFSESTLRPLGRTAAGVKGISLREGDTVVGLDVADSESEDEVLVVTENGYGKRTPVSEYRLSNRGGKGIKTATITERNGNIVCITTVTGEEDLMVVTNAGVIIRLDVHDISQNGRAAQGVRLMKLGDGQFVSTVAKVNEEDDNEENADEAQQSTTTETADVEEVVDDQTPGNAIHTEGDAEMESVESPENDDRIDIRQDFMDRVNEDIESASDNEEDSDE

SEQ ID NO: 5158 - protein, 88 aa, Staphylococcus epidermidis
IHSNSSRHCGLVDKSKKLTNSTVIHMWINCVCCVLFFHIIHNCYFLFRGTTPHLFKCLGIDLHSNYSLKDSLQSANFQFIQYGFISHY

SEQ ID NO: 5159 - protein, 171 aa, Staphylococcus epidermidis
LQNKNGNITKEIEEENLDIPPEALNYIANQIQSNIRELEGALTRLLAYSKLQGKPITTELTAEALKDIIQSPKSKKITIQDIQKIVGQYYSVRIEDFSAKKRTKSIAYPRQIAMYLSRELTDFSLPKIGEEFGGRDHTTVIHAHEKIANDIKSDPTFKQEVENLEKEIRNQ

SEQ ID NO: 5160 - protein, 150 aa, Staphylococcus epidermidis
RRMKVIFTQDVKGKGKKGEVKDVPVGYANNFLLKNKYAVEATPGNLKQLEQQNKRAEADRQQEIDDAKALKEQLKDIEVEVSAKTGEGGKLFGSISTKQIAEALKKQHDIKIDKRKMDLPHGIHALGYTNVPVKLDKEVEGTIRVHTVEQ

SEQ ID NO: 5161 - protein, 648 aa, Staphylococcus epidermidis
SNEKVMVNTLSDVNNTDNYGAGQIQVLEGLEAVRKRPGMYIGSTSERGLHHLVWEIVDNSIDEALAGYASHIEVVIEKDNWIKVTDNGRGIPVDIQEKMGRPAVEVILTVLHAGGKFGGGGYKVSGGLHGVGSSVVNALSQDLEVYVHRNGTIYHQAYKQGVPQFDLKEIGDTDKTGTAIRFKADKEIFTETTVYNYETLQKRIRELAFLNKGIQITLKDEREEEVREDSYHYEGGIKSYVDLLNENKEPLHDEPIYIHQSKDDIEVEIALQYNSGYATNLLTYANNIHTYEGGTHEDGFKRALTRVLNSYGTQSKIIKEDKDRLSGEDTREGLTAVVSIKHGDPQFEGQTKTKLGNSEVRQVVDRLFSEHFERFLYENPSVGRIIVEKGIMASRARVAAKKAREVTRRKSALDVSSLPGKLADCSSKNPEESEIFLVEGDSAGGSTKSGRDSRTQAILPLRGKILNVEKARLDRILNNNEIRQMITAFGTGIGGEFDISKARYHKIVIMTDADVDGAHIRTLLLTFFYRFMRPLIEAGYVYIAQPPLYKLTQGKQKYYVFNDRELDKLKQELNPSPKWSIARYKGLGEMNADQLWETTMNPEHRSMLQVRLEDAIDADQTFEMLMGDVVENRRQFIEDNAVYANLDF

SEQ ID NO: 5162 - protein, 61 aa, Staphylococcus epidermidis
CSSFIYLIKNINIEIERKVTLQAVNYNNVEILSPLIREKLYVYRHNVSTITQNKIFSFNKL

SEQ ID NO: 5163 - protein, 372 aa, Staphylococcus epidermidis
TMKLNTLQLENYRNYEQVTLDCHPEVNILIGENAQGKTNLLESIYTLALAKSHRTSNDKELIRFKSDYAKIEGELSYRHGTMPLTMFITKKGKQVKVNHLEQSRLTQYIGHLNVVLFAPEDLNIVKGSPQIRRRFIDMELGQISAVYLNDLAQYQRILKQKNNYLKQLQIGQKTDTTMLEVLNQQFAEYALKVTLRREHFIKELETLAQPIHAGITNDRETLTLDYVPSLKLSNYEANQSELIEEVLALLNDNLQREKERGVCLYGPHRDDLSFNVNGMDAQTYGSQGQQRTTALSIKLAEIELMNIEVGEYPILLLDDVLSELDDSRQTHLLSTIQHKVQTFVTTTSVEGIDHEIMNNAKLYRISQGEILK

SEQ ID NO: 5164 - protein, 662 aa, Staphylococcus epidermidis
KVIRGGRMNRQSTKKALLIPFILMVLTAIALVVVWFIFNQLVAGIATAILIVMIIISGVLLRKAFLKMDNYVDDLSGHISASSNKAIKHLPIGMIVLDEDNHIEWMNQFMTDHIETNVISENVNEVFPNILKQLEKVQEVEIENNNYYYHVRYSENEHCLYFFDMTETERTNELYEDSKPIIATIFLDNYDEITQNMNDTQRSEINSMVTRVISRWAQDYNIYFKRYNSDQFVAYFNQKILAELEDSNFEILSQLREKSVGYRAQLTLSIGVGEGTENLIDLGELSQSGLDLALGRGGDQVAIKNMNGNVRFYGGKTDPMEKRTRVRARVISHALKDILTEGDKVIVMGHKRPDLDAIGAAIGVSRFASMNNLEAFIVLNDSDIDPTLRRVMDEIDKKPELKERFVTSDEAWDMMTSKTTVVVVDTHKPEMVLDENVLNKANRKVVIDHHRRGESFISNPLLVYMEPYASSTAELVTELLEYQPTEQRLTRLESTVMYAGIIVDTRNFTLRTGSRTFDAASYLRAHGADTILTQHFLKDDVDTYINRSELIRTVKIQDQGVAIAHGSDDKIYHPVTVAQAADELLSLEGIEASYVVAKREDNLIGISARSLGSINVQLTMEALGGGGHLTNAATQIKGATIDEAIEQLQQAITEQMSRSEDA

SEQ ID NO: 5165 - protein, 96 aa, Staphylococcus epidermidis
WHLRQIVQLHCYVAFDFAHTFHPLSTYTSYFNPSFILSSSDIVTRYTTDISEVNKLYKSYILYNCTYNSNHVLSSRHIFKLLFYSVHTDCTFDFFV

SEQ ID NO: 5166 - protein, 385 aa, Staphylococcus epidermidis
TTGRSLNLMMEFTIKRDYFINQLNDTLKAISPRTTLPILTGIKIDAKENEVILTGSDSEISIEITIPKQVDGEEIVEITETGSVVLPGRFFVDIIKKLPGKEVKLSTNEQFQTLITSGHSEFNLSGLDPDQYPLLPEVSRDDAIQLSVKVLKNIIAQTNFAVSTSETRPVLTGVNWLIQDNELICTATDSHRLAVRKLQLEDESENKNVIIPGKALSELNKIMSDSDEDIDIFFASNQVLFRVGNINFISRLLEGHYPDTTRLFPENYEIKLGINNGDFYHAIDRASLLAREGGNNVIKLSTGNELVELSSTSPEIGTVKEEVNANDVEGGNLKISFNSKYMMDALKAIDNDEVEVEFFGTMKPFILKPKDDDSVTQLILPIRTY

SEQ ID NO: 5167 - protein, 328 aa, Staphylococcus epidermidis
RRYGTIMTNYTVNTLELGEFITESGETIDHLRLRYEHVGLPGQPLVVVCHALTGNHLTYGTDAQPGWWREIIDGGYIPVHDYQFLTFNVIGSPFGSSSKLNDDNFPEHLTLRDIVRAIELGIQALEFKKINILIGGSLGGMQAMELLYNRQFEVEKAIILAATDKTSSYSRAFNEIARQAIHIGGKEGLSIARQLGFLTYRSSKSYDQRFTPDEVVSYQQHQGDKFKEYFDLNCYLTLLDVLDSHHLDRGRDDVDEVFQSLETKVLTMGFIDDLLYPDDQVRALGERFKYHRHFFVPDNVGHDGFLLNFNDWAPNLYHFLNLKQFRRK

SEQ ID NO: 5168 - protein, 467 aa, Staphylococcus epidermidis
IMDGMYEQNQMPHSNEAEQSVLGAIIIDPELINTTQEVLLPESFYRGAHQHIFRAMMHLNEDNKEIDVVTLMDQLSSEGSLNEAGGPQYLAELSTSVPTTRNVQYYTDIVFKHALKRKLIQTADSIANDGYNDELELDTILSDAERRILELSSTRESDGFKDIRDVLGQVYETAEELDQNSGQTPGIPTGYRDLDQMTAGFNRNDLIILAARPSVGKTAFALNIAQKVATHEDMYTVGIFSLEMGADQLATRMICSSGNVDSNRLRTGTMTEEDWSRFTIAVGKLSRTKIFIDDTPGIRINDLRSKCRRLKQEHGLDMIVIDYLQLIQGSGSRFSDNRQQEVSEISRTLKAIARELECPVIALSQLSRGVEQRQDKRPMMSDIRESGSIEQDADIVAFLYRDDYYNRGEGDEDDDDAGFEPQTNDDNGEIEIIIAKQRNGPTGTVKLHFMKQYNKFTDIDYAHADMS

SEQ ID NO: 5169 - protein, 279 aa, Staphylococcus epidermidis
HVMGGYVVMKTLDSVNIPIRKDETHKGDYGKILLIGGSANMGGAIMLAARACVYSGSGLITVATHPNNHAALHSRCPEAMVIDINDTKMLTKMIEATDSILIGPGLGVDFKGNNAITFLLQNIQPHQNLIVDGDAITIFSKLKPQIPTCRVIFTPHQKEWERLSGIPIEEQTYERNLEAVERIGATVVLKQHGTEIYFCNDDVYKLPIGTPAMATGGMGDTLAGMITSFVGQFDNFKEAVTSATYMHSFIGEKLSDTMYVVPPSRLISEIPYVMKQLEG

SEQ ID NO: 5170 - protein, 454 aa, Staphylococcus epidermidis
CSIFICKFKIILVKYLVVKREKLGGAHMSSIVVVGTQWGDEGKGKITDFLAEQADVIARFSGGNNAGHTIQFGGETYKLHLVPSGIFYKDKLAVIGNGVVVDPVALLKELDGLNERGISTDNLRISNRAQVILPYHLAQDEYEERRRGDNKIGTTKKGIGPAYVDKAQRIGIRMADLLEKETFERRLKENIEYKNAYFKGMFNETCPTFDEIFDEYYAAGQRLKDYVTDTAKILDDANVADEKVLFEGAQGVMLDIDHGTYPFVTSSNPVAGNVTVGTGVGPTSVSKVIGVCKSYTSRVGDGPFPTELFDEDGHHIREVGREYGTTTGRPRRVGWFDSVVLRHSRRVSGITDLSINSIDVLTGLDTVKICTAYELDGEKITEYPANLDQLRRCKPIFEELPGWTEDITGCRSLDELPENARNYLERISELCGVHISIFSVGPDREQTNLLEQLW

SEQ ID NO: 5171 - protein, 311 aa, Staphylococcus epidermidis
SKSMGVAYVFSKIQPKATILAIISLLVVALVTHVLPVLGLILCLFATIPGIVLWNRSIQSFGISALVTVVLTTLLGNTFVLSMMVLILLLSAIIGQLLKERTSKERILYISTASLSLVTLIGWMLLQTFDKIPTAAVLIKPFKNAMHEAFLTSGIDSNYRQILEESFRQMTVQLPSFLIIVIFIFVLINLIITFPILRKFKVATPIFKPLFAWQMSRNLLWFYLIVLICVMIASEPSTFQSIVLNFDVVLSLVMYIQGLSVIHFFGKAKRWPNFATILVMVVGTLLTPATHIVGLLGVIDLCINLKKIIKK

SEQ ID NO: 5172 - protein, 156 aa, Staphylococcus epidermidis
EITIENIYCTHCMCDCDDASSKFNSTFIRSNFNSRNCCCIVRGGDGKMTTDLHTLVLIVLCGVVTLLVRVIPFIMISRVNLPAIVIKWLSFIPITLFTALIIDGVIQQHDHAFGYTLNLPYIIAIVPTVMLAIFTRSLTVTILGGIFVIACLRLIF

SEQ ID NO: 5173 - protein, 68 aa, Staphylococcus epidermidis
NQNVYNLTFKDYQKIIMTKLLQLFKTSLIFNFLLKFYLEIVIFKRYLILFDIITPSNETRCNNIELAT

SEQ ID NO: 5174 - protein, 80 aa, Staphylococcus epidermidis
EILVQEVVVEGNITLGQFLKTEGIIESGGQAKWFLQDFEVLINGQRETRRGKKLEHNDRIDITDIPEDTGSFLIIHQGEQ

SEQ ID NO: 5175 - protein, 211 aa, Staphylococcus epidermidis
RRISMIVKFCGFKTESDIKKIKKLEVDAVGFIHYPDSKRHVSLKQLKYLAKIVPDHIEKVVVVVNPQMSTIKRIINQTDINTIQLHGNESIQLIRNIKKLNSKIRIIKAIPATRNLNNNIQKYKDEIDMFIIDTPSITYGGTGQSFDWKLLKKIKGVDFLIAGGLDFEKIKRLEIYSFGQCGYDISTGIESYNEKDFNKMTRILKFLKGDE

SEQ ID NO: 5176 - protein, 62 aa, Staphylococcus epidermidis
IQTSSWLNIRKVTAQRAENNQKNYKKDNFYIFSIEIVFFTYLEPFCPSLFRDSFFNYLQRNF

SEQ ID NO: 5177 - protein, 108 aa, Staphylococcus epidermidis
IAAPKPIGTATIVAITVIFNVPMMSAQIPNSGDEPVGFQVPDKKNLDNGTRVKNVIVSVKSVNKIAIVVNIDIAEIMAKIIGTILSLSPPFLALFLAIISLTFVCEAM

SEQ ID NO: 5178 - protein, 1010 aa, Staphylococcus epidermidis
DLKPLHIVMENFGPFIKETIDFEQVETDQLFLISGKTGSGKTMIFDAIVYALYGMASTKTRKEGDLRSHFADGKSPMSVIYQFKVNNQTFKIHREAPFIKEGNITKTQAKLNIYELVDNQFELRESKVNQGNQFIVQLLGVNAEQFRQLFILPQGEFKKFLQSNSKDKQSILRTLFNSERFDEIRHLLVENVKQEKVQIENRYTQIENLWNDIDTFNNDELALYKELESSQTDKMIEKFPQFNDYGCKILKSFEEAKNKITKELDDLNHKYKVNVELSENTKKLKAEKIKFDDLKKEQNYIDKLKQELKMIQESKVLITYFTRLQSLKKDKDELVSLHEQSKLNETNYHNEIKGFQKQLEHLSTRENEITQFNQYLEKNQVFFNQLDKIISSYQQKPVIEEEIKRLYSEYNDLITKKEELTKEMNNKNKDFAIIEHYTEEIYKLKKIIDESERQKKDEKLFDKLQLDKSSYLSKLKEKKEQLNEIESSITNIDATLIDLNDKKDFVNEIKSAMSIGDTCPICGNEIHSLGEHIDFESIAQKNNKIKRLESKKVKIRDEIIKIETRIEELNHRENELNFEKQEKKDISELQKQLNHLNQLKDEQQSINKLVENFEKQEKEIVNKIHQFDLDLSRKNTQKEKLEIQINDFERHSQFSSVNDFETYYSHAKKQVETYEYENEKTKDKLNELNNKLKIEMNDQKHLTENLTQTSKEINNLELKMEKEMQQLGFESYDQVKSAADLSAQKDEIEREINIYNKNYQSYEIEINRLKELVKGKKLLNLEELRQSIEKTNLKLDETNSQIATISYKIDNNSNKFNKIKNIIQILDDELKVQKEIFLLSEILAGKNDYKLTLENYVLIYYLEKIIFQANQRLSFMSGNRYQLIRRETISLGLSGLEIDVFDFHSNKSRHISSLSGGETFQASLALALGLSEVVQQESGGITLDSMFIDEGFGTLDQETLETAIDTLINLKSSGRMVGIISHVSELKQRIPLILEVTSNQYESHTQFRKN

SEQ ID NO: 5179 - protein, 89 aa, Staphylococcus epidermidis
ANKFMSKEGVNLTYLVFSIVFAFLMGAVVIVIRMKAQQFPVNEKKIILPPFSMLPCIDVLYPYFRLTGMDNVRIIDIRCFVFYCFNLDF

SEQ ID NO: 5180 - protein, 187 aa, Staphylococcus epidermidis
KIFTLVKLKHGKTVNSSWPDKKINAVSPNSSHGTYDFFEEEVMDKQDIKAEKNADTNAIVSSVTKNKEGIGYFGYNFYEQNKDKLKEVKIKDDNGKVTEPTKKTIQNGSYALSRPLFIYAKDKSLKDNKVMSEFMKFVLEDEGKAAEDAGYVASPKKTYKSQLDDLKDFLDKHQKSDKKDDKKSEDK

SEQ ID NO: 5181 - protein, 102 aa, Staphylococcus epidermidis
LNHTLILNLLGIFLTDLFLICYVVIFSVKFNSGITIISMILCYVVIKITDNINKIKFSPSNFTNLDTDKSFIFNLSIMSSITIVYIFIIYLLAITIFRKIQF

SEQ ID NO: 5182 - protein, 340 aa, Staphylococcus epidermidis
RLDTYPLMYQAALFLARFKVLMSLIQSLYNSKKFQNRFLFNLGIKHYNFNNDIRKVIMMSKYVITKTLNNNVIICTKNHQEVVLIGKGIGFNKKVGMTVQENASIEKIYKLEQQEQQEHYKTLLELGEDHVVQAVIESVNIINESGLITDDKNLVVALTDHIIYAYKRLKQHQMITNPFVIETKHLYSNAYNVARKVIDKLNKTLDVHFPEDEIGFIALHIASNSEKLSIHDISVINKLINKSITIIETDLQHSIDKQTIQYQRFIRHIQFLIYRLTKGEYLEAQENFISMIKTMYPRSFNTAYKILKMIQREFSVYVYEAEIVYLTLHINHFEVQISSE

SEQ ID NO: 5183 - protein, 102 aa, Staphylococcus epidermidis
GDNTMNIKLTQKAVEWFKNELDLPISNKVLQFYVKYGGEFQLKQGFSPAFTVENKDAIDIGFEQTFYEINVVIAEKDLWYFQDEKLTVDAIDHEDEIIYKRN

SEQ ID NO: 5184 - protein, 60 aa, Staphylococcus epidermidis
EFLTTLERVFNVRVNITLACTECGDRNYITTKNKRNNPERIEMKKYCPRLNKYTLHRETK

SEQ ID NO: 5185 - protein, 313 aa, Staphylococcus epidermidis
ERGFYMASQTKVREMIAKNNAKKGGLSDKIVPIILAIISAISILTTIAILFTLLTETITFFTRVPLSKFFLSGTWNPTGSSPEFGIWALIIGTLKITVIATIVAVPIGLGAAIYLNEYASDRSRRIIKPILEILAGIPTIVFGFFALTFVTPILRNLIPNLGEFNSISPGIVVGIMIVPMITSMSEDAMSSVPDKIREGAFGLGATKFEVATKVVLPAATSGVVASIVLGISRAIGETMIVSLAAGSSPTSSLSLTSSIQTMTGYIVEIATGDAAFGSDIYYSIYAVGFTLFIFTLIMNLLSQWISKRFREEY

SEQ ID NO: 5186 - protein, 93 aa, Staphylococcus epidermidis
NNRTNLVKCIRIKKAGETMAIWVAIILIVIALIAGLIGGFLLARKYMKDYLKKNPPINEEMLHMMMMQMGQKPSQKKINQMMTMMNKNMNQKM

SEQ ID NO: 5187 - protein, 310 aa, Staphylococcus epidermidis
TLLTYNITSRSQYIKEFLIMANSQVAEKEKLDAQTNNQDSVATIVTTENNKKNTIPDSEKKIVYSTQNLDLWYGENHALQNINLDILENNVTAIIGPSGCGKSTYIKALNRMVELVPSVKTAGKILYRDQNIFDAKYSKEKLRTNVGMVFQQPNPFPKSIYDNITYGPKTHGIKNKKILDEIVEKSLRGAAIWDELKDRLHTNAYGLSGGQQQRVCIARCLAIEPDVILMDEPTSALDPISTLRVEELVQELKENYSIIMVTHNMQQAARVSDKTAFFLNGYVNEYDDTDKIFSNPADKQTEDYISGRFG

SEQ ID NO: 5188 - protein, 331 aa, Staphylococcus epidermidis
VNMTEQKDIKETEYRRQKGTTSTPFRRRNKKRMRKLPFIILVILIILISIIVYITHQYNSGMKYAKEHAKDVKVHKFNGNMKNDGKISVLVLGADKAQGGKSRTDSIMIVQYDYVHKKMKMMSVMRDIYADIPGYDKYKINAAYSLGGPELLRKTLNKNLGVNPEYYAVVDFTGFEKMIDELQPNGVPIDVEKDMSENIGVSLKKGHHKLNGKELLGYARFRHDPEGDFGRVRRQQQVMQTLKQELVNFNTVAKLPKVAGILRGYVNTNMPNSAIFQTGISFGIRGDKDVQSLTVPIKGSYQDINTNNDGSALQIDSEKNKQAIKNFFEDN

SEQ ID NO: 5189 - protein, 99 aa, Staphylococcus epidermidis
LVWTMLESLILGVLFSTVLIWTSRFEVKDDNIYMKRSKAFPIILISLLIIRTVIKIFISSEIDPGEIAGMFFLLAFCMIVPWRCAMLYKYKKLQKNLIK

SEQ ID NO: 5190 - protein, 243 aa, Staphylococcus epidermidis
KQAAKGGQHLIMIQFDHVDYSYHRKQPVLKDINISIQRGEKIGVLGESGAGKSTIGSLILGQLKPTKGKISIDSGKVLPIFQHATESFDRQFTIEQSLREPLLFYRQLIRQNIKNIILNYLIEFNLSTDLITKFPQEVSGGQLQRLNIIRSLLAQPDILVCDEITSNLDVMAEQNVINILLNEKNIQNKTLIVISHDLSVLQRLTNRIIVIKDGQIVDDFKSKDLFSHKRHPYTKLLIQTYEY

SEQ ID NO: 5191 - protein, 129 aa, Staphylococcus epidermidis
FDYFLSKSLISVNKTVFSSTSSSFSSFFITVLAILTKINKAKAIMMKSIIDCMKSPYLIPQKDQSSAKLTEPNNLPINGMMMYWTRDVTILLNAAPITTAIAKSKTLPLSANSLNSFNIKHNPSFKIYF

SEQ ID NO: 5192 - protein, 80 aa, Staphylococcus epidermidis
VGNAENWSSNPLGVAKSIVGIPIITSGAVSPNARDKDKMKPVKIPGNAAGKTTLLIVCHLLAPRPYDASLTELGTALIAS

SEQ ID NO: 5193 - protein, 217 aa, Staphylococcus epidermidis
DAMAIIRQKYEGQLDGLIKDLRRLGLRVYFNINNALVSLGEEKKSFARQTIEKDKEINHLDHEINEKVIMLITRQQPIAKDLRMMMAALKISTDFERMGDNAASIAHIRLRVKINDNYVFTRLKTMGKLAMLMLEDLNNAIRNKDLPLIKEVIERDEDIDDLYVNIVNTSYLIDNDPFVAGQAHLAARHLERIGDHISNIAESVYYYLTGQHFETFD

SEQ ID NO: 5194 - protein, 145 aa, Staphylococcus epidermidis
VLFYLSLHYCLSLLCFVTSADSATFVLGMQTTFGSLNPSSLVKVTWGVAQALIAFVLLLAGGGDGSKALNAIQSAAIISAFPFSFVVIMMMISFYKDANKERKFLGLTLTPNKHRLQEYVKYQQEDYETDILEKREVRRNKEKEE

SEQ ID NO: 5195 - protein, 423 aa, Staphylococcus epidermidis
EGNYLIMKFTELTVKEFENFVQNPSLESHYFQVKENIATRESDGFQVVLLGVKDDDNRVIAASLFSKIPTMGSYVYYSNRGPVMDYSDLGLVDFYLKELDKYLHQHQCLYVKLDPYWLYQVYDKDINPLTEKNDALVNLFKSHGYDHHGFTTQYDSSSQVRWMGVLDLEGKTPASLRKEFDSQRKRNINKAINYGVKVRFLSKDEFDLFLDLYRETEARTGFASKTDDYFYNFIEHYGDKVLVPLAYIDLNEYIQHLQESLNDKENRRDDMMAKENKTDKQLKKIAELDKQIDHDKKELLQASELRQTDGEILNLASGVYFANAYEVNYFSGGSSEKYNQYMGPYAMHWHMINYCFDNGYDRYNFYGLSGDFTENSEDYGVYRFKRGFNVRIEELIGDFYKPINKVKYWLFNTLDRIRNKLKK

SEQ ID NO: 5196 - protein, 346 aa, Staphylococcus epidermidis
YFLYSLKVKGCQHMFKMIIYKLSQMIVVLFILTTITFILMKLSPGNPVDKILHLDISHVSNEQIETTENKLGLNNPIFIQWWDWLNQLFHFDLGTSYQTSEPVIREIANYLGPTLIITFGTLIVSLVISIPLGIIAAVYYHKIWDRIIRVMTSLSVSLPSFFIGLILLYIFSLKLNILPTSDEGRFVSYILPIITMSIGMCAYYIRFIRSTLLEQYQTPIVESSRLRGMPERYILFQDILKPTILPIIPLLGLSIGSLIGGTVVIENLFDIPGLGYFLVDSIKSRDYPVIQGCVLFIGFFVVIINTIADLLSLLIDPKQRYAITQKETSKFKWFNSHRKEGRNDEV

SEQ ID NO: 5197 - protein, 269 aa, Staphylococcus epidermidis
LLSYMLKIYICILKSSNITPRTFVCISNLSEHKFCVNNITNKCVLENVINDIIISNNNKECLFMRELTKRQSEIYDYIKKIVQTKGYPPSVREIGEAVGLASSSTVHGHLSRLEEKGYIRRDPTKPRAIEIVSEQLDEVNVEETIHVPVIGKVTAGVPITAVENIEEYFPLPEHLTSTHNSDIFILNVVGESMIEAGILDGDKVIVRSQTIAENGDIIVAMTEDEEATVKRFYKEKNRYRLQPENSTMEPIYLDNVIVVGKVIGLYREM

SEQ ID NO: 5198 - protein, 342 aa, Staphylococcus epidermidis
FYKYSNERKLKMTLLEKIKQNKSLSKKDMQSFIVTLFDSNIETNVKVELLKAYTNKDMGQYELTYLVEYFIQTNYPNQPFYNKAMCVCGTGGDQSNSFNISTTVAFVVASAGVPVIKHGNKSITSHSGSTDVLHEMNIKTNKMNEVEQQLNLKGLAFISATDSYPMMKKLQSIRKSIATPTIFNLIGPLINPFKLTYQVMGVYEASQLENIAQTLKDLGRKRAILIHGANGMDEATLSGENIIYEVSSERALKKYSLKAEEVGLAYANNDTLIGGSPQTNKQIALNILSGTDHSSKRDVVLLNAGIALYVAEQVESIKHGVERAKYLIDTGMAMKQYLKMGG

SEQ ID NO: 5199 - protein, 317 aa, Staphylococcus epidermidis
IYYHNGSLNDSERSINMSTHSNTANKTLIDKDAVEKNISSRDRKNSVNKWLFLLCTLIGLIVLVALLIQTFVKGAGHLTPEFFTNFSSSTPADAGIKGALVGSIWLILSIIPISIILGIGTAIYLEEYARDNIFTQIVKVSISNLAGVPSIVFGLLGYTLFVGAAGLGNSVLAAALTMSLLILPVIIVASQEAIRAVPSSVREASYGLGANKWQTIRRVVLPAALPGILTGFILSLSRALGETAPLVMIGIPTILLATPSGLLDQFSALPTQIYTWAKMPQAEFQNVASAGIIVLLVILLLMNTVAILLRNKFSKKF

SEQ ID NO: 5200 - protein, 323 aa, Staphylococcus epidermidis
TQLQIYFHYLSILNNVMLLLRKKHQSLNGLIHIEKKVVTMKFKLSKKNTIFFIFTVYIICLIVLQFIINDEAAYQVHLSNSFEPMSMNHLLGTDDYGRDLFSRLVVGSRATLFVTLLTLLFTVVVGVPLGLLAGYKKGWIDTIIMRIIDIGLSIPEFVIMIALASFFHPSLWNLVIAITIIKWMNYTRVTRGIVNTEMNQSYIQMAQFFNVSTLNILFKHLLPKVLPSIFVIMIVDFGKIILYISSLSFLGLGAQPPSPEWGAMLQAGREFITSHPIMIIAPASLISGTILIFNLTGDAVRDRLLEQRGVKVETFNNKKSKHQ

SEQ ID NO: 5201 - protein, 421 aa, Staphylococcus epidermidis
MVVNYNDNGELTMGGTSLKTIAQSFGTPSIVYDEDQIRNQIRRYHKAFEASGLSYNISYASKAFTCIQMVKLIDEENLQLDVVSEGELYTALEAGFDSKRIHFHGNNKTKREIQYALDNQIGYFVVDTLEEIELIDKYADSNVDVVLRVNPGVEAHTHEFIQTGQEDSKFGLSIKHGLALNAVNKVKATKHLQLKGIHFHIGSQIEGTEPMIKTAKIVLNWLASERIEVSLLNIGGGFGIKYVEGDESFPIEQGISEITEAIKETAQALQYNIPEIGIEPARSIVGEAGITLYEVGTIKDIPGVNKYVSVDGGMSDHIRTALYGAQYEALLVNRNEKANESVTIAGKLCESGDIIVRDAPLPSSVHRGDYLAILSTGAYHYSMASNYNQMQKPPVFFLKDGKAREVIKRQSLRQLIINDTK

SEQ ID NO: 5202 - protein, 388 aa, Staphylococcus epidermidis
GMDNFMNELEFVTLHRRHLHQYPELSLHEFETTSYITSFLEDLGVPYDRPLKTGVIAYLEGNSHHTIAFRADIDALPIYEENDIDFKSKNDNVMHACGHDGHTTALMLFVKRCKALYDKSELPHNVVFIFQPAEETGGGANRLIKAGAFDKYPIEAVFGFHVNPFEKEGKIVIRDEEITASATEYRFFLKGLSSHVADKEQGHSCGEGLQHVLSQIGQIQQFHLNGLKRNIIHMGHFEAGEAINTVPSHGYLEGTIRTYDTEDLAIVKHQMHKIAKSVQLLFNVECEVKFEEGYPPTMNHPQLRQAVENAIKGANLEIVEKKLPFLFGEDFSFYGQQLAPSYFVFVGTQNNEKGFVTGLHTAHLNFDEKILIDVVNYYEHLLRNYKEV

SEQ ID NO: 5203 - protein, 428 aa, Staphylococcus epidermidis
CFCKGGSVMYDYNLLEDRDVLCIDQKSFFASVSCMEKGLDPLTTKLAVVADTKRQGSVVLAATPKLKELGIKTGSRLFEIPHRNDIYIINPSMRKYLNVSVAISKIALRYVPPEDLHQYSIDEFFMDVTDSYHRFNSTVFAFCKRFQNEILEETGIHCTIGIGSNMLLSKVAMDIEAKHSENGIAEWRYQDVPEKLWPIQPLRDFWGINKRTEKKLNKRGIFTIGDLAKYPYHYLKRDFGVLGIDMHLHANGIDQSKVREKYKVTNPSICKSQILMRDYQFEESKVVMQELIEDVASRLRAEKKLARTIHFSFGYAEGGGIHKQYTLEDPTNLERDIFKVINYFANRLCDKKALYRTLSVSLTQFIKESDRQLNLFIDEYERKKDVKLAKTIDHLHLKYGKGIVSKATSYTEAGTKHGRLGLMAGHKM

SEQ ID NO: 5204 - protein, 333 aa, Staphylococcus epidermidis
FYCKGLKKMKIFDYEDIQLIPNKCIVESRSECNTSVKFGPRTFKLPVVPANMQTVMNEELAQWFAENDYFYIMHRFNEENRIPFIKKMHHAGLFASISVGVKENEFNFIEKLASSSLIPEYITIDIAHGHSNSVINMIKHIKKHLPNSFVIAGNVGTPEGVRELENAGADATKVGIGPGRVCITKIKTGFGTGGWQLSALNLCNKAARKPIIADGGLRTHGDIAKSIRFGATMVMIGSLFAAHEESPGETVELDGKKYKEYFGSASEYQKGEHKNVEGKKMFVEHKGSLKDTLTEMEQDLQSSISYAGGKDLKSLRTVDYVIVRNSIFNGDRD

SEQ ID NO: 5205 - protein, 171 aa, Staphylococcus epidermidis
MNINTAYFAGGCFWCMTKPFDTFDGIEKVTSGYMGGHLVNPSYEEVKTGSTGHYEVVKIEYDVALFSYHKLLEIFFSVIDPLDDGGQFQDRGSQYKTAIFYSNEHQRQLAEQYICELQDSFNADKAIATKILPASTFYEAEAYHQDFYKKNPERYEQEQQDRASYVKNNHM

SEQ ID NO: 5206 - protein, 125 aa, Staphylococcus epidermidis
IITKVEAHIIILIIKVYMSHSLNTRNPPFPTDGDGYEYNYRQDDDNYFEQPGKLFRLQSEDAKERIFTNTANAMDGVSKDVKVRHIRHCYKADPEYGKGVAKALGIDINQIDLETNQDETYENFK

SEQ ID NO: 5207 - protein, 105 aa, Staphylococcus epidermidis
VLLKLTEYLLIIMIAIIKFNALRKRFQMSKENLNIDRINELARKKKEHGLTNEEAKEQTKLRRQYLEEFRKGFKQQIENTKVIDPEGNDVTPEKLKKIQEEKHNK

SEQ ID NO: 5208 - protein, 914 aa, Staphylococcus epidermidis
RHINIYKYQGGYKMASNIKEQAKKQFELNGQSYTYYDLQTLEEKGLAKISKLPYSIRVLLESVLRQEDDFVITDDHIKALSKFGNAGNEGEVPFKPSRVILQDFTGVPAVVDLASLRKAMNDVGGDINKINPEVPVDLVIDHSVQVDSYANPEALERNMKLEFERNYERYQFLNWATKAFDNYNAVPPATGIVHQVNLEYLANVVHVRDVDGEKTAFPDTLVGTDSHTTMINGIGVLGWGVGGIEAEAGMLGQPSYFPIPEVIGVRLTHSLPQGSTATDLALRVTEELRKKGVVGKFVEFFGPGVQHLPLADRATIANMAPEYGATCGFFPVDEESLKYMKLTGRDEEHIELVKEYLQQNHMFFDVEKEDPEYTDVIDLDLSTVEASLSGPKRPQDLIFLSDMKKEFEKSVTAPAGNQGHGLDQSEFDKKAEINFNDGSKATMKTGDIAIAAITSCTNTSNPYVMLGAGLVAKKAVEKGLKVPEFVKTSLAPGSKVVTGYLRDSGLQQYLDDLGFNLVGYGCTTCIGNSGPLLIEIEKAVADEDLLVTSVLSGNRNFEGRIHPLVKANYLASPQLVVAYALAGTVDIDLQNEPIGKGKDGKDVYLQDIWPSIQEVSDTVDKVVTPELFLEEYKNVYHNNEMWNEIDVTDEPLYDFDPNSTYIQNPTFFQGLSKEPGKIEPLKSLRVMGKFGDSVTTDHISPAGAIGKDTPAGKYLLDHDVAIRNFNSYGSRRGNHEVMVRGTFANIRIKNQLAPGTEGGFTTYWPTGEIMPIYDAAMKYKEDGTGLVVLAGNDYGMGSSRDWAAKGTNLLGVKTVIAQSYERIHRSNLVMMGVLPLQFQQGESAEALGLDGKEEISVDINEDVQPHDLVNVTAKKENGEIINFKAIVRFDSLVELDYYRHGGILQMVLRNKLAQ

SEQ ID NO: 5209 - protein, 362 aa, Staphylococcus epidermidis
RGVKQLTAIWSLDTEAFYQNAVKVKNNEPIMAVVKNNAYHYGLEFAVKTFLKAEINTFSTTSLNEAIRVRKIAPEATIFLMNPVYDFDLVKRYDIHMTLPSLNYYYKYKQDLKGIHVHLEYENLLHRSGFRNIEEIREVLKDHDQNNQDKMIISGIWTHFGYADEFDVDEYKMERDAWLNLINTLLNENYHFDMIHSQNSASYFRENQMLLPHHTHARVGIALYGSRPYSLINEERITQSLTVKGNVIQVRDVNKGDYCGYSFAFEVKNDHTQLAVVDIGYGDGILKSRAKHEAIINGKRYPIRALMMSHMFIEVDDEVHAQDEVILYNKDIRIDEFTFKGVGANSEQLSAMNHDSLMKEYL

SEQ ID NO: 5210 - protein, 423 aa, Staphylococcus epidermidis
LIMNSSSQEKKNKKFSSVFIYSSIIAAIVVIIGAVWPEKFDSVTNTAKMWITNNLGWYYLILTTVIVFFCVFLIFSPIGKLKLGKPNDKPEFNTISWFAMLFSAGMGIGLVFYGAAEPMAHFAAPPTADPETTKAYTESLRSTFFHWGFHAWAIYGVVALALAYSQFRKGEPGLISRTLRPLLGDKVEGPIGTLIDVLSVFATLVGVAVSLGMGALQINGGLHYLFGVPNNTFVQGIIIVVVTILFIASAWSGLSKGIQYLSNLNIGLGTILMIVTLIVGPTVLILNMMTSSTGSLLNSFLFNSFDTAALNGQKRDWMSTWTLYYWGWWLSWSPFVGVFIARVSKGRSIREFISGVLLVPALVSFIWFSVFGVLGIEAGKKDSGLFKMSPETQLFGVFNHIPLGIVLSIIALLLIASLLCYFS

SEQ ID NO: 5211 - protein, 256 aa, Staphylococcus epidermidis
LIMNFIFDIDGTICFDGCSIDSSIKQRLFKLRQANHNVIFASARPIRDLLPVIPEFADDTLIGGNGSIISKNGQIEIVSVINEHDISLIKKIIKKYQLSYIIDDKFNYASNLDSNNELYQRIDPDGKAQSLDMDEIRNPIKAILLNIDNKDFDMIAHQLVSQSHGIELIRHYSESYIDVTARGVDKYTTIQYILGTNSDYIAFGNDHNDVHMLEHASQGYFVTNQFIEHTSFFKNKNITVIDDTIYAICEVLDRYL

SEQ ID NO: 5212 - protein, 242 aa, Staphylococcus epidermidis
TIMNILLIGYGAMNQRVARLAEDKGHEIVGVIDRTSKASTPYSQYQHISECKEADVAIDFSNPELLFPLLEEQFNLPLVIATTGEKETLIQKLETLSQRTPVFFSANMSYGVHALTKILETAVPLLQDFDIELTEAHHNKKVDAPSGTLVKLYDVIKELRDNVSPVYDRHEKTEKRTHDEIGIHAVRGGTIVGEHDILFAGTDETITISHKAQSKDIFANGAIGAAEKLIHKNPGFYTFNNL

SEQ ID NO: 5213 - protein, 410 aa, Staphylococcus epidermidis
GVVNLMKNEKEINGKKSHFFSLSESRFMRFLGGNDLIYALIALVLLGIVIFIFDKISYVFQPFIIVFNTIAAPIIVSLVLFYLFNPIVNMMERYRIPRLLGITIIYVAIVGIITLIVNLLIPIIGSQIESFIKNTPNYLHKITRSLDKLNNNTILSGYMGQVNEWLESAQKKIPSMVSDYSDGFGSKLATFAEAVANIGIVIGTTPFVLFFMLKDGHKFKDYTTKIMPPKFRKDFHDLLEKMSVQVGSYIQGQIIVSFCIGLLLFIGYSIIGLKYALVLASIAAVTSVVPYLGPTIAISPAIVIAIITSPLMLLKLAVVWTLVQFFEGHFISPNVMGKTLKIHPLTIIFILLCAGNLMGIVGVIIGIPLYAVLKVLVSHIFMLFKRRYNRYYGNDAGEYIITEEEKGIKQ

SEQ ID NO: 5214 - protein, 90 aa, Staphylococcus epidermidis
YMAKKSKIAKEQKRQELVNKYYELRKELKAKGDYEALRKLPRDSSPTRLTRRCKVTGRPRGVLRKFEMSRIAFREHAHKGQIPGVKKSSW

SEQ ID NO: 5215 - protein, 303 aa, Staphylococcus epidermidis
IKENRMALDKDIVGSIEFLEVVGLQGSTYLLKGPNGESVKLNQSEVADEDNFELGEEYSFFVYPNRSGDLFATQNMPDITKDKYDFAKVIKTDRDGAHIDVGLPREVLVPWEDLPKLKELWPKAGDYLLVTLRIDSTNQMFGRLASETIVESMFTPVNDDSKQNEYISARAYRLLRVGSFLLSNEGYKIFVHESERKHEPRLGEAVEVRIIGHNEKGELNGSFLPLAHERLDDDGQVIFDLLVEYDGELPFWDKSSPDAIKEVFNMSKGSFKRAIGHLYKKKIINIETGKITLTKKGWSRVDD

SEQ ID NO: 5216 - protein, 164 aa, Staphylococcus epidermidis
VKVERRIIPMIYSLTEIEARYQETDKMGVIYHGNYATWFEVARTDYIRKLGFSYASMEEQGVISPVVDLKVQYKKSIYYPEKVTVKTWVEKYSRLRSTYCYKVYNENGELATTGSTELICIKADTFKPIRLDRYFPEWHETYSKVNQLNKEGKDAEVTFGINHL

SEQ ID NO: 5217 - protein, 164 aa, Staphylococcus epidermidis
NRSENMTQELKSKLLSFFKFIFATALFIFVIFTLYRELSHINFKETFIQFGKINRLWLVLLFAGGGLSLILLSLYDIILVKALKLKMPLIRVFRVSYIINALNSIIGFGGFIGAGVRAFVYKNYTNDTKKLVQYIFIILVSMLTGLSLLSILVVLRIFNASSHD

SEQ ID NO: 5218 - protein, 804 aa, Staphylococcus epidermidis
GGNELSEIIQDLSLEDVIGDRFGRYSKYIIQERALPDVRDGLKPVQRRILFAMYSSGNTYDKNFRKSAKTVGDVIGQYHPHGDSSVYDAMVRLSQDWKLRHVLIEMHGNNGSIDNDPPAAMRYTEAKLSQLSEELLRDINKETVSFIPNYDDTTLEPMVLPARFPNLLINGSTGISSGYATDIPPHNLAEVIQGTLKYIDQPDITINQLMKYIKGPDFPTGGIIQGIEGIKKAYETGKGKVVVRSRVDEEPLRSGRKQLIVTEIPYEVNKSSLVKRIDELRADKKVDGIVEVRDETDRTGLRIAIELKKDANSESIKNYLYKNSDLQISYNFNMVAISEGRPKLMGLREIIESYLNHQIEVVTNRTRYDLEQAEKRMHIVEGLMKALSILDEVIALIRNSKNKKDAKDNLVAEYDFTEAQAEAIVMLQLYRLTNTDIEALKKEHEELEALIKELRNILDNHEALLAVIKDELNEIKKKFKVDRLSTIEAEISEIKIDKEVMVPSEEVILSLTQHGYIKRTSTRSFNASGVTEIGLKDGDRLLKHESVNTQDTVLVFTNKGRYLFIPVHKLADIRWKELGQHISQIVPIDEDEEVVNVYNEKDFKNEAFYIMATKNGMIKKSSASQFKTTRFNKPLINMKVKDKDELINVVRLESDQLITVLTHKGMSLTYSTNELSDTGLRAAGVKSINLKDEDYVVMTEDVNDSDSIIMVTQRGAMKRIDFNVLQEAKRAQRGITLLKELKKKPHRIVAGAVVKENHTKYIVFSQHHEEYGNIDDVHLSEQYTNGSFIIDTDDFGEVESMILE

SEQ ID NO: 5219 - protein, 675 aa, Staphylococcus epidermidis
LKIDINCRREDTTMFNEKDQLAIDTIRALSIDAIEKANSGHPGLPMGAAPMAYTLWTRHLNFNPQSKDFFNRDRFILSAGHGSALLYSLLHVSGSLELEELKQFTQWGSKTPGHPEYIHTDGVQVTTGPLGQGFAMSVRMALAESHLAGKFNKDQFDIVNHYTYVLASDGDLMEGISHEAASFAGHNQLDKLIVLYDSNDISLDGDLYKSFSEDTKQRFEAYGWNYILVENGNDLDEIDNAITQAKSQQGPTIIEVKTIIGFGSPNKAGSNGVHGAPLGEEERALTFKEYGLDPEKRFNVPEDVYEIFKSTMLKRANENEEAWNNMLKNYSEAYPELAEEFKLAMSGKLPNNYADALPEYDLNHSGASRADSGEIIQKLSEFVPSFFGGSADLAGSNKSNVKEAKDYNKDTPEGKNVWFGVREFAMGAAINGMAAHGGLHPYAATFFVFSDYLKPALRLSSIMGLNSTFIFTHDSIAVGEDGPTHEPIEQLAGLRAIPNMNVIRPADGNETRVAWEVALESEHTPTSLVLTRQNLPTLDVDKQTVENGVRKGAYIVFETEQQLEYLLLASGSEVNLAVEAAKELEQQGKGVRVISMPNWYAFEQQSSEYKESILPSDVTKRIAIEMASPLGWHKYVGIEGKVIGINSFGASAPGDLVVEKYGFTKENILKQVRSL

SEQ ID NO: 5220 - protein, 232 aa, Staphylococcus epidermidis
CQIEVCPKGFRNMHGFGSHKYSMYNDKGERVWVKYHFRTQQGIENYTDEEAAKIVGMDRDSSQRDLYNAIENGDYPKWKMYIQVMTEEQAKNHPDNPFDLTKVWYKKDYPLIEVGEFELNRNPENYFLDVEQAAFTPTNIVPGLDYSPDKMLQGRLFSYGDAQRYRLGVNHWQIPVNQPKGVGVENLCPFSRDGQMRFLDNNQGGGPHYYPNNQGIYESQPEHKKPTIPDRW

SEQ ID NO: 5221 - protein, 299 aa, Staphylococcus epidermidis
KEQDNMTHMFEGVGVALATPFTNNEVDFNALERHVQFLLNNNIQAIIVNGTTAESPTLSDEEKEKVLATVVKLVNHSVPVIAGTGTNNTYKSIQASIRAKEIGADAVMLITPYYNKTNQRGLIQHFETIANEVKLPVILYNVPSRTNMTIEPETVGILSHNPYIVALKDATNDFDYFDQVKQRINTNEFALYSGNDDNVVKFYQRGGNGVISVIANVIPQEFQYLYDQRQNETDITNYFKPIEKLLEALSLDVNPIPIKVLTAYLGYGHYEVRLPLVPLEEAQCKQVERAFEQFKAGEQ

SEQ ID NO: 5222 - protein, 259 aa, Staphylococcus epidermidis
KLKLLTIKNLNINDKEGQAIIKNVDLNIYNQSLNVIIGESGAGKSLTVKAILNHLPTQLHMSFDEFKMQGQNTSGIKQLLGKHIGYISQNYAQSFNEYTRLDKQLIAIYRYHFNVSKDNALKKIKKALTWVNLNDESIINKYSFQLSGGQLERVNIASVLMLDPELIIADEPVASLDVVNGHQIMQLLQHIVKDHHNTVLLITHNMNHVLKYADYFNVMRNGMMIESGEIDKLFNHHHLHRYTEQLLNYRSKLQKEDNI

SEQ ID NO: 5223 - protein, 67 aa, Staphylococcus epidermidis
KNIFIKILHSYFLFSRWNDIFKMNHGPIYYLHMIIFDITSTILLFLFITFRVLFVEILMVCFRFIKS

SEQ ID NO: 5224 - protein, 195 aa, Staphylococcus epidermidis
KFIGGNSMILIIDNYDSFTYNLVDIVEKQCETIVKYPDDTDICNLKGITAVIISPGPGHPLDNQLLIKLIENFENLPILGVCLGAQALTCYYGGDVIQGSCVKHGKVDTLTIVNQSPLYKGIKSSFKVMRYHSLISDPCSFPESLLITGQTYDSIQSFQHKNRKHYGIQFHPESFATENGKQIIINFINIATRGS

SEQ ID NO: 5225 - protein, 424 aa, Staphylococcus epidermidis
NKFGIPNLFFFILCMSPLIIGGLKLNRSVLKFGGSSVSDFKKIKNIAEMLKTRIEDGEELIVVVSAMGKTTDQLMNNVSSLTSTPKDQELALLLTTGEQQTVSYLSMVLNDIGVNAKAMTGYQAGIKTVGHHLKSKIAEINPNIFNEAFKNHDILVVAGFQGINEDFELTTLGRGGSDTTAVALAASNQTPCEIYTDVDGVYATDPRIHNEAKRLEYVSYEEMMEMSALGAGVLETRSVELAKNYDIPLYLGRTLSNVKGTWIMSKSDLLEKKAVTGVALDTHMMHVTISYPLPDNQLLTQLFTALEEESVNVDMISQIVNLEGLQLSFSIKDSDAHQISSILENLSTHFSALDYKINEAYVKISLIGSGMRDMSGVASKAFTTLINSDIPFYQTTTSEISISYVIDEENGEKAVEELYHAFEI

SEQ ID NO: 5226 - protein, 603 aa, Staphylococcus epidermidis
MSEGLPLREEVPVKETWDLKDLFTSDQAFYQTLEQVVQMSLDFNHTYYQKLNNIETIEKALDEYERILIEIDRLYNYPELRLSVDTSNEEAQKVNAKLNTTSGKLAGLLSFVDSEILELPDEIISELRSQTKYPHFIKQLQDRKPYQLSADVEKVLATLTPTLRSPFELYGTTKSLDINFESFDYEGVTYPLDYATFENEYEDHPSPEFRRKSFRAFSDALRQYQHTTAATYNMQVQQEKIEADLRGYDSVIDYLLQDQEVTKDMFDRQIDVIMSDLAPVMQKYAKIIQRVHNLDKMRFEDLKISIDPNFEPEISIEESKKYIYGALKVLGDDYVKMLESAYDYRWIDFAQNKGKDTGAYCASPYITHSYVFISWTGKMAETFVLAHELGHAGHFTLAQNHQNLLESEASMYFVEAPSTMNEMLMANYLFNSSNNPRFKRWVIGSILSRTYYHNMVTHLLEAAYQREVYSRVDNGESLTAPLLNEIMLNTYKAFFGDTVEMTDGVELTWMRQPHYYMGLYSYTYSAGLTIGTVVSQCIKKEGQPAVDRWLKTLQAGGSQSPIELAQIAGVDITTDAPLKETINYISNLVDELEVLTYQIKENS

SEQ ID NO: 5227 - protein, 299 aa, Staphylococcus epidermidis
KKKGQLSKSLVKKAIKAQQAREAARKAREDARSGKKNKRKDTLLSGKLTPAQSKNTDKNELYLVEGDSAGGSAKLGRDRKFQAILPLRGKVINTEKARLEDIFKNEEINTIIHTIGAGVGTDFKIEDSNYNRIIIMTDADTDGAHIQVLLLTFFFKYMKPLVQAGRVFIALPPLYKLEKGKGKNKKVEYAWTDEELENLQKQLGKGFILQRYKGLGEMNPEQLWETTMNPETRTLIRVQVEDEVRSSKRVTTLMGDKVAPRREWIEKHVEFGMQEDQSILDNKEVQILENEKYIEEETN

SEQ ID NO: 5228 - protein, 119 aa, Staphylococcus epidermidis
ILLIGARAMTIFDMPNYLWITILGMILLTVFYTLVLNKWFQSAIITFVVLAVLAFFIPNFQNISYQPLLGYAGFLGIMSLIISFLIWYFSRNWRKNRRKIKLEKEIRKYDDEESLRRHK

SEQ ID NO: 5229 - protein, 332 aa, Staphylococcus epidermidis
LFIMTRLAVAGATGLVGTKMLETLDRKQIPFDELVLFSSARSAGKKVEFQGQLYTVQELTDEAASEHFDYVLMSAGGSTSEHFAPLFEAAGAIVIDNSSQWRMAEDVDLIVPEVNEPQFTRGIIANPNCSTIQSVVPLKILQDAYGLKRVAYTTYQAVSGSGVKGKRDLAEGANGKEPEAYPYPIYNNVLPHIDVFLENGYTKEEQKMIDETKKILNDQDLKVTATCVRVPVQDSHSIEIDVTLNQDTTVKEIQELFAQDQRVVLVDNPSKNEYPLAIHSTGKDEVFVGRIRRDDSLENTFHVWCTSDNLLKGAALNAVQVLEQILTLKGAR

SEQ ID NO: 5230 - protein, 422 aa, Staphylococcus epidermidis
MGVMKMKFTNLTAKEFSDFTDRMTYSHFTQMEGNYELKVAEGTESHLVGIKNNDNEVIAACLLTAVPVMKIFKYFYSNRGPVIDYNNKELVHFFFNELSKYVKKYNCLYLRVDPYLPYQYLNHEGEITGNAGHDWIFDELESLGYKHEGFHKGFDPVLQIRYHSVLNLANKSANDVLKNMDGLRKRNTKKVKKNGVKVRFLSEEELPIFRSFMEDTSETKDFADREDSFYYNRFKHYKDRVLVPLAYINFDEYIEELNNERNVLNKDYNKALKDIEKRPENKKAHNKKENLEQQLDANQQKINEAKNLKQEHGNELPISAGFFIINPFEVVYYAGGTSNRYRHFAGSYAVQWKMINYAIEHGINRYNFYGISGDFSEDAEDAGVVKFKKGYDADVIEYVGDFIKPINKPMYNIYRTLKKLKK

SEQ ID NO: 5231 - protein, 263 aa, Staphylococcus epidermidis
VMTILNEIIEYKKTLLERKYYDKKLEILQDNGNVKRRKLIDSLNYDRTLSVIAEIKSKSPSVPQLPQRDLVQQVKDYQKYGANAISILTDEKYFGGSFERLNQLSKITSLPVLCKDFIIDKIQIDVAKRAGASIILLIVNILSDDQLKELYSYATNHNLEALVEVHTIRELERAHQINPKIIGVNNRDLKRFETDVLHTNKLLKFKKSNCCYISESGIHTKEDVEKIVDSSIDGLLVGEALMKTNDLSQFLPSLKLKKNLYDS

SEQ ID NO: 5232 - protein, 134 aa, Staphylococcus epidermidis
NIYMLYNQKYILKEGLCFMLKEFKEFALKGNVLDLAIAVVMGAAFNKIVTSLVQYIIMPLIGKLFGSVNFAEDWSFWGIKYGLFIQSIIDFIIIAFALFIFVKIANTVMKKEEKEEEVEENTVLLTEIRDLLKK

SEQ ID NO: 5233 - protein, 498 aa, Staphylococcus epidermidis
IYYILLIKVVPRVSVLITKEADFFRKRRKSMDIVYKKVNAQITPEALAKLKQKKIIFESTNQQKLKGRYSIVVFDHYGKITLDNSQLLIKLDNHCEIVKNQPYQRLKEFVDKYYFEIKDKYLKDLPFISGFIGTCSFDLVRHEFKKLQDIKLEDHQTHDVQFYLVEDVFVFDHYKDELYIIASNLFSDRTKERLKESIERKIEDLKNIHFSVEDINYKSIPRHITTNISEQQFVQTIRILKKKITEGDMFQVVPSRIYSYKHHFQHNLHQLTFQLYQNLKRQNPSPYMYYINKDVPIVIGSSPESFVKVKDGKVYTNPIAGTIKRGQNKKEDENNEKTLMKDEKELSEHRMLVDLGRNDIHRISKTGTSQITKLMTIERYEHVMHIVSEVIGELKPHLSPMSVIASLLPTGTVSGAPKLRAIQRIYESYPYKRGIYSGGVGYINCNHHLDFALAIRTMIIDEEKVSVEAGCGVVYDSIPEKELEETKLKAKSLLEVTP

SEQ ID NO: 5234 - protein, 391 aa, Staphylococcus epidermidis
KKHIELKRTNVLIRRIIMKIVHTADWHLGKILNGKQLLEDQKYILTQFKQHMEKEQPDLIVIAGDLYDTSYPSKEAIGLLEETIEYLNIELKIPIIMISGNHDGRERLNYGSKWFENNQLYIRTQLENIDDPIELSGVQFFTLPFATVSEVQNYFKDKQIETYQQALNECLEQMSSSIDNNKVNILIGHLTIEGGKTSDSERPLTIGTVESVDMHSFRLFDYVMLGHLHHPFSINNSFIKYSGSILQYSFSEVNQSKGYRVLDIENNQLLNETFVPLKPLRELEVIEGDYEDIIQERIKVKNKNNYFHFKLTNVSHITDPMMKLKQIYPNILALSNVVFDHSENFSHVEIKKQDDQTIIENFYKNMTDQHLSQVQSDKIKHLLSFILDREG

SEQ ID NO: 5235 - protein, 341 aa, Staphylococcus epidermidis
VNTIKRFLLLITVLLCIVIFTPVKETTFMIKAQNDIRHQINRWIDSDSNDDNTQLAIPKKQEFAINNIQMNMTKKDVEAQLGQHKRMTSSVYGTNWYTYYSNDYNQFLMVSYINNHVNALYTNQNLISSKSQIKYDTPKDVVRERYGPPIQVIKKGKVGFDVKSNEYDVFHKDHIYTTVFYDKHRDNGVKSLLQVSEKMENRLRYQYGKPSKLLAKSFELQNFDIVNAERKQHGLKTLDYSKDVSHTARKHSVDMVKHNYFDHVNQKKLSPFDRLKKDGIEFNAAGENLAYGQLNSIYAHEGLMNSLGHRKNILNTHFDYLGVGVYFNDRRQPFWTENYTS

SEQ ID NO: 5236 - protein, 403 aa, Staphylococcus epidermidis
LMKIQTEVDELGFFGEYGGQYVPETLMPAIIELKKAYEDAKSDTHFKKEFNYYLSEYVGRETPLTFAESYTKLLGGAKIYLKREDLNHTGAHKINNAIGQALLAKRMGKTKLVAETGAGQHGVASATIAALFDMDLIVFMGSEDIKRQQLNVFRMELLGAKVVSVSDGQGTLSDAVNKALQYWVNHVEDTHYLLGSALGPDPFPTMVRDFQSVIGNEIKSQILSKEGRFPDALVACVGGRSNSIGTFYPFIQDDVKLYGVEAAGKGSHTHNHALAIGKGKPGVLHGSKMYLIQNDDGQIELAHSISAGLDYPGIGPEHSYYNDIGRVSYVSATDNEAMEALITFSKVEGIIPAIESAHALSYVEKLAPNMDEKEIIVVTISGRGDKDMETIKQYKENGGEQNE

SEQ ID NO: 5237 - protein, 383 aa, Staphylococcus epidermidis
ILEMTHIQYCYSENSETRRRSMRNILFVGLGLIGGSLASNLKYHYSNFNILAYDSDYTQLDEALSIGIIDQKVNDYATAVEIADIIIFATPVEQTIKYLSELTNYNTKTHLIVTDTGSTKLTIQSFEKELLKHDIHLISGHPMAGSHKSGVLNAKKHLFENAYYILVFNEIENNEAATYLKKLLKPTLAKFIVTHANEHDFVTGIVSHVPHIIASILVHLSANHVKDHSLIEKLAAGGFRDITRIASSNAQMWKDITLNNQNHILSLLNEIKEQITGIENLIREQNSNSIYDFFVKAKDYRDQLPVKQHGAISTAYDLYVDIPDKPGMISQITNIISSHNISIINLKILEVREDIYGALQISFKSPEDRENAIKALANFDTYY

SEQ ID NO: 5238 - protein, 67 aa, Staphylococcus epidermidis
QRRMLIMPIINVKLLEGRSDEQLKDLVTEVTHAVEKTTGANKEAIHVVIEEMRKDHYAVGGVRKSDQ

SEQ ID NO: 5239 - protein, 204 aa, Staphylococcus epidermidis
VFMMIIVMLILSYLIGAFPSGLIIGKLFFKKDIRQYGSGNTGATNSFRVLGRPAGFIVTFLDIFKGFITVFFPLWFPVHADGVISTFFTNGLIVGLFAILGHVYPIYLKFNGGKAVATSAGVVLGVNPILLLILAIIFFSVLKIFKYVSLSSIIAAISCVIGSIIIHDYILLAVSGIVSIILIIRHKSNIVRIFKGEEPKIKWM

SEQ ID NO: 5240 - protein, 79 aa, Staphylococcus epidermidis
YWMILKYKYKFLTYMTIVIVCCIIFSNFFLSVNQGVQSEQTYEMTDHKIHQHNQQGTTQNYKDKQNSEQNDQSVFALVN

SEQ ID NO: 5241 - protein, 489 aa, Staphylococcus epidermidis
EGFVLQDFDNLIPGWFKTFVQVGNDLIWSQYLIGLLLTAGFFFTISSKFIQLRMLPEMFRALTEKPETLSSGEKGISPFQAFAISAGSRVGTGNIAGVATAIVLGGPGAVFWMWIIAFIGAASAFMEATLAQVYKVHDKEGGFRGGPAYYITKGLNQKWLGIVFAVLITVTFAFVFNTVQANTIAESLNTQYNISPVITGIVLAVITGIIIFGGVRSIATLSSLIVPIMAIVYIGMVLIILLLNIDQIVPMIGTIIKSAFGVQQVTGGAVGAAILQGIKRGLFSNEAGMGSAPNAAATSAVPHPVKQGLIQSLGVFFDTMLVCTATAIMILLYSGLQFGDSAPQGVAVTQSALNEHLGSAGGIFLTVAVTLFAFSSVVGNYYYGQSNIEFLSNNKMILFIFRCFVVLLVFVGAVAKTETVWSTADLFMGLMAIVNIISIIGLSNIAFAVMKDYQRQRKEGKRPVFKPENLEINLFGIETWGQHAKMPKK

SEQ ID NO: 5242 - protein, 384 aa, Staphylococcus epidermidis
RTYVCRRAKSLAMNKQNNYSDDSIQVLEGLEAVRKRPGMYIGSTDKRGLHHLVYEVVDNSVDEVLNGYGDAITVTINQDGSISIEDNGRGMPTGIHASGKPTAEVIFTVLHAGGKFGQGGYKTSGGLHGVGASVVNALSEWLEVEIHRDGNIYTQNFKNGGIPATGLVKTGKTKKTGTKVTFKPDSEIFKSTTTFNFDILSERLQESAFLLKDLKITLTDLRSGKEREEIYHYEEGIKEFVSYVNEGKEVLHDVTTFAGHSNGIEVDVAFQYNDQYSESILSFVNNVRTKDGGTHEVGFKTAMTRVFNEYARRINELKDKDKNLDGNDIREGLTAIISVRIPEELLQFEGQTKSKLGTSEARSAVDSVVSEKLPYYLEEKGPII

SEQ ID NO: 5243 - protein, 145 aa, Staphylococcus epidermidis
IELVKLRDDVGELPAAKETIIVSPIALDIPNTIEATTPEVAAGNTTFVATSNLVAPNPNAPSRILSGTDDIASSLILVIIGTIIIPTTIPGLIELNSPKLGIRFLNIGVTNVKAKKPNTIVGIPAKISNIGLMILRERSDAYSLR

SEQ ID NO: 5244 - protein, 535 aa, Staphylococcus epidermidis
MLQVTDVSLRFGDRKLFEDVNIKFTEGNCYGLIGANGAGKSTFLKILSGEIDSQTGHVSLGKDERLAVLKQDHFAYEDERVLDVVIKGHERLYQVMKEKDEIYMKPDFSDEDGIRAAELEGEFAEMNGWNAEADAANLLSGLGIEPDLHDKNMSELENNQKVKVLLAQSLFGDPDVLLLDEPTNGLDIPAISWLEDFLINFENTVIVVSHDRHFLNNVCTHIADLDFGKIKLYVGNYDFWYQSSQLAQKMAQEQNKKKEEKMKELQDFIARFSANASKSKQATSRKKQLEKIELDDIQPSSRRYPYVKFTPEREIGNDLLTVENLSKTIDGEKVLDNVSFTMNPNDKAILVGDSEIAKTTLLKILAGEMEPDEGTFKWGVTTSLSYFPKDNSEFFDGVDMNLVEWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNQAGALSKEVPYEEYLQEIGVLQNN

SEQ ID NO: 5245 - protein, 247 aa, Staphylococcus epidermidis
IKGVIQLMVQHLSAQEIIQYISDAKKSTPLKVYVNGHFENVTFPESFKVFGSEHSKVIFCEADEWKQFYQQNHSLITELEIEMDRRNSAIPLKDLTNTNARIEPGAFIREQAIIEDGAVVMMGATINIGAIVGEGTMIDMNATLGGRATTGKNVHVGAGAVLAGVIEPPSASPVVIEDNVLIGANAVILEGVRVGAGAIVAAGAIVTQDVPAGAVVAGTPAKVIKQTSEVQDSKREIVSALRKLNNE

SEQ ID NO: 5246 - protein, 266 aa, Staphylococcus epidermidis
LFQVVEIKIWKQLNNTKKTVVNKMSKLFIPYIMGDLNFIHHLKTLTENGADIVEIGVPFSDPVADGPIIMKAGRNAIDEGSNIKFIFDELIKNKNTISSKYVLMTYYNILSAYGEELFLDKCDEAGVYGLIIPDLPYELTKKFKKDFYHHSVKIISLIAMTASDARIMQIAKNSEGFIYTVTMNATTGNSGEFHPDLKRKIEYIKKVSKIPVVAGFGIKNPEHVKDIASVADGIVIGSEIVKRIEIDSRKEFITYIKSIRTTLNSL

SEQ ID NO: 5247 - protein, 226 aa, Staphylococcus epidermidis
FEEVYIFMSKKVLFVLTSTSQFTDGTETGLWLEEAGAPYNILTEEGINVDVISIKGGKVNLDPNSVSNESLNQYAKFVSHLNDTPSIENVNADEYDAIYLPGGHGTVYDFANNEKLADILLQFKNSNKIISSVCHGPSAFVGVKDANNHYLVDGVKITSFTDSEEKAMGFENKVPFLTQSKLEEQGANFVVKDDFTSHVEKDGQFITGQNPQSSEDIGKALANELK

SEQ ID NO: 5248 - protein, 81 aa, Staphylococcus epidermidis
LLVFLYTLYLRYWFHTYLCYLNEDTIATMEMMLVSTLSLKKKKELNNNIYNFRLEQQNNNVPVFFIFKSHTFAIMICLVII

SEQ ID NO: 5249 - protein, 213 aa, Staphylococcus epidermidis
PNKLKRCLLEEKLAGSAHDGKLTGLFGAPVSDRENSMTAGQRGPLLMQDVYYLEQISHFDREVIPERRMHAKGSGAFGTFTVTNDITQYTNAKIFSEVGKQTEMFARFSTVSGERGAADLERDIRGFALKFYTEDGNWDLLGNNTPVFFFRDPKLFISLNRAVKRDPRTNMRSAQNNWDFWTGLPEALHQVTILMSDRGMPKRIPKYAWIRFS

SEQ ID NO: 5250 - protein, 682 aa, Staphylococcus epidermidis
LMKFSWVRWILYIVALFLPIFIFYTVARPVDRNNRNMGVYCTVVSCVEWMAAATVLYFAALIVDIHISFMTFVRIFVIAALSGLVSFIPGGFGAFDLVVLLGLKSLGISEEKILLALVLYRFAYYFVPVMIALILSSFEFGNTAKKYLDNSKYFIPVKDFTSFLRSYQKDILAKVPSFSLAILIFLTSIIFFINNLTIVYDGLYDGNHFAYYIALAVQTSACLLLILNVRGIYKGSRRAIIYAFISIILIASATIYTYASFLLLSWLIIIFVLLILAYQRAQVLKRPLRFKKLAVMLLLSIFILYLNHILISGTLYALDVYHIEIDTSLLRYYFWMTIVIIMLLVGVIAWLFDYKYKCPHHSIDLTLCDAIIQKYGGNYLSHLVYSGDKDCFFNENKDSFIMYRYKSNALVVLGDPIGNTKSFESLLEAFYQFAEYQGYEIIFYQISDQYMPLYHNFGNQFFKLGEEAIIDLTTFTTSGKKRRGFRATLNKFDDLNINFEIIEPPFTQDFFDELKFVSDKWLDGRSEMHFSVGQFTQTYLSKAPIGVMRDHSGKMIAFCSLMPTYSNNAISVDLIRWLPELDLPLMDGLYLHMLLWSKEKGYKAFNMGMATLSNVGQLHYSYLRERMAGRVFEHFNGLYRFQGLRRYKEKYSPNWEPRFLVYQKHYSLWESMLKVMRVIRHK

SEQ ID NO: 5251 - protein, 67 aa, Staphylococcus epidermidis
SYISLCRLVSSLINRHSLLLFEIIISLITFSNTHLFVMLLTQNLCSDKLLIQTNVLGVILDDFKIQI

SEQ ID NO: 5252 - protein, 156 aa, Staphylococcus epidermidis
EDVSMKKWQLVGTTVLGASVLLGACGGNDGGSGDGKDLKGSAKGEGSSTVAPIVEKLNEKWAKDHKDAKISSGQAGTGAGFQKFIAGETDFSDASRPIKDEEKKKLEDKGIKYHEFKIAQDGVTIAVNKDNDFVKELTKSQLKDIYSGKAKTWKDR

SEQ ID NO: 5253 - protein, 68 aa, Staphylococcus epidermidis
IQTSSWLNIRKVIAQRAENHQKNYKKDNSYIISIEIVFIYLFWNFLFQAFHIYIDIDLIIITMFVGIK

SEQ ID NO: 5254 - protein, 331 aa, Staphylococcus epidermidis
EVKSLVKSGKARAHTNIALIKYWGKADETYIIPMNNSLSVTLDRFYTETKVTFDPDFTEDCLILNGNEVNAKEKEKIQNYMNIVRDLAGNRLHARIESENYVPTAAGLASSASAYAALAAACNEALSLNLSDTDLSRLARRGSGSASRSIFGGFAEWEKGHDDLTSYAHGINSNGWEKDLSMIFVVINNQSKKVSSRSGMSLTRDTSRFYQYWLDHVDEDLNEAKEAVKNQDFQRLGEVIEANGLRMHATNLGAQPPFTYLVQESYDAMAIVEQCRKANLPCYFTMDAGPNVKVLVEKKNKQAVMEQFLKVFDESKIIASDIISSGVEIIK

SEQ ID NO: 5255 - protein, 90 aa, Staphylococcus epidermidis
THKSLRRIQYMTKNTLNDLNNHLFAQLERLSDEELKGEELQEELNRSKAVSDVAKNIVSNGNLILQAHKFKDEQMNADAKLPKMLENKEK

SEQ ID NO: 5256 - protein, 108 aa, Staphylococcus epidermidis
NNPSSNSPRNIELVIVVTSSSVLNSANSSIHMIEKGNRLSFNDFNRSGFCAPLKIIRFPLGTYVISIGDTLTLNRCDTFCSSIAHLICSNTDVANVLSVLRTTTAFIG

SEQ ID NO: 5257 - protein, 141 aa, Staphylococcus epidermidis
GGTLSKYNSKKVEYKGVVFDSKIECDFYQHLERNLGNEYDHIELQPRYELIPKFDNQRKTEYIADFALWKNNKLLEVIDVKGMPTEVAKLKAKIFRYQNREVPLTWICKAPKYTGQEWITYEELIKVRRKRKKEKMKDGKD

SEQ ID NO: 5258 - protein, 331 aa, Staphylococcus epidermidis
FGVLYMCTAISLYTKQRYHYLARTMDFAFEFNGIPTIVPRHYHYQFDLDSDMRLEYGFVGTNLKVGRYRFGDGINEKGLAISNHYFTGEASYSTHKRYGYFNLAPEEFIVWVLGFNKSISELKQKVKKINIMNEKNTTLNIVPPLHFMVTDETGHTVAIEPHNGLLIVKDNYVHTLTNEPKLDWHLSNLRNYAFLTPQKSTNQLIGKVLVRSMGCEAGTNGLPGGYTSTDRFIRATYLRHQLRCSHNEDENLMNCFKVLESVSIPQGAVIDANKIHYTQYQLVMESKERSYYIKPYFSNQIFKIKLTEDLLSKNEMTFLPINHELKITSIQ

SEQ ID NO: 5259 - protein, 405 aa, Staphylococcus epidermidis
AGEPAFLHKKWYTYHKVINMKIINNNFTFHKGKNWINLSGLPRKKTKRGEQIIWKNSIGYNVNYFFEGISGDIKILDSYRKNDERYLKVEVKNETYEIRSSNFKNCEIKKIVTDGYKHNLGFIINGCKVIGKRLNPRSKEREYKMLCLNTNLTFYRRESRIDVGAPSPYISGKYVYEGNWLYNEKNVLPFLKDVNDAKKYTKFSRREINCVCPNCKTEKTTPVNNLVQQGFFCHVCSTNISYPEKLMIALLNENSVVFEYQKIFQDLKPKRFDFYLPEYNLVIETHGKQHYKENEIWYRKSKESDVVKMSYCKKKNIKYVEVDCSLSDYNFIMNNINKTELKHVLKLYDKENIIKRIKELEQIKDVDEIIKLYKNGRNLTYISRNVGLTKWKIEGLLKRLGYIAR

SEQ ID NO: 5260 - protein, 226 aa, Staphylococcus epidermidis
RRLPIMTDERHVLVIFPHPDDETFSSAGTIASYIEKGIPVTYACLTLGQMGRNLGNPPFATRESLPFIRERELEEACKAIGITDLRKMGLRDKTVEFEPYDQMDQMIQSLIDETNPSLIISFYPKFAVHPDHEATAEAVVRTVGRMHESDRPRLTLVAFSNDASEILGEPDIQNDISQYSDIKLKAFEAHASQTGPFLKQLASPEIDGQAQSFLKIEPFWTYHFES

SEQ ID NO: 5261 - protein, 277 aa, Staphylococcus epidermidis
MMALKKVLTIAGSDTSAGAGMQADLKTFQELDVYGMVALTSIVTMDKETWSHDVTPIDMNVFEKQLETAISIGPDAIKTGMLGTQDIIKRAGDVFVESGADYFVVDPVMVCKGEDEVLNPGNTEAMIQYLLPKATVVTPNLFEAGQLSGLGKLTSIEDMKKAAQVIYDKGTPHVIIKGGKALDQDKSYDLYYDGQQFYQLTTDMFQQSYNHGAGCTFAAATTAYLANGKSPKEAIIAAKAFVASAIKNGWKMNDFVGPVDHGAYNRIEQINVEVTEV

SEQ ID NO: 5262 - protein, 91 aa, Staphylococcus epidermidis
SKYTEVVKLRHKLLKTANDLNKLILHSDEKVKAEFHTFDNGEVGITFWHYSQKYESDCNHLNFYEFFTDKELQRSFELAKDVIAGECLIDE

SEQ ID NO: 5263 - protein, 112 aa, Staphylococcus epidermidis
SADTMLTKLLTTSGNDVEYTINPQAIIKGNTSFLLKPKFLIIAKAIGVKIKVAPSLAKNAAIIAPNIMINTNIFNPCPCDALTICMADHSKNPISSRINEIRITATKVSVAF

SEQ ID NO: 5264 - protein, 173 aa, Staphylococcus epidermidis
GIPTHMKKNHDYMRLAINEAHKAKALGEVPIGAVIVKEDQVIARAHNLRETLQQPTAHAEHIAIERASEVVGSWRLEECTLYVTLEPCVMCAGTIIMSRIPKVVYGATDPKGGCSGSLMNLLEQPQFNHRAIVEKGILEEECAELLRSFFKEIREKKKAEKQGKIQKDINLLK

SEQ ID NO: 5265 - protein, 175 aa, Staphylococcus epidermidis
RMATCARLCRLYKKQTQIKGVFMGLYEKMLIEHDYIEVRETDVMPNDLHGLWLGDLILIKRNLSEIRKAEVLYEELAHHKLTYGNILDQSKFNNRKFENYARRYGYETALPLRIIVEAHNYGVSNLYELAEYVQLSEEYISEILKHYKNKYGIGTNYGEYLITFDPLRVFKYKEI

SEQ ID NO: 5266 - protein, 84 aa, Staphylococcus epidermidis
YSKTTLFSFNKAIINFSGYDMLVEHTWQKKPCWTKLLTGVVFSVLQLGQTQFISLLENFVYFFASLTSFKKGKTFFSLYNQFPS

SEQ ID NO: 5267 - protein, 308 aa, Staphylococcus epidermidis
ENMTRQGYGESTGKIILMGEHAVTFGQPAIAIPFNAGKIKVLIESLDEGNYSSITSDVYDGMLYDAPEHLKSIINRFVEKSGVKEPLSVKIQTNLPPSRGLGSSAAVAVAFVRASYDFMDQPLDDKTLIKEANWAEQIAHGKPSGIDTQTIVSNKPVWFKQGQAETLKSLKLNGYMVVIDTGVKGSTKQAVEDVHVLCESDEYMKYIEHIGTLVHSASESIEQHDFHHLADIFNACQEDLRHLTVSHDKIEKLLQIGKEHGAIAGKLTGGGRGGSMLLLAENLKTAKTIVAAVEKAGAAHTWIEHLGG

SEQ ID NO: 5268 - protein, 69 aa, Staphylococcus epidermidis
PQMTLGNRIKQHRQDKGLNMREFGEFIDNASDSIVSRWERNISVPNAKRLKLIADDMNITVTELLKGVK

SEQ ID NO: 5269 - protein, 146 aa, Staphylococcus epidermidis
YTMTKLNLKQQAFVDEYIKTGTAYQSAIRAGYSEKYAKSSSHKLLENVGIKAEIDKRMEKLKKDSIADQDEILQYLTSVLRGEVTDQELIPIQVGRGEMEVEELEKRSDTNARTKAAELLGKRYMMWTDKQQIETTAMVHFDDDIN

SEQ ID NO: 5270 - protein, 67 aa, Staphylococcus epidermidis
PPTAFVPNAIGKTLTSDLPNRTCFTIKSHLLYLKYLNILYPNHNLFIHVNYLLEASILTLKSLYALM

SEQ ID NO: 5271 - protein, 248 aa, Staphylococcus epidermidis
YTYAYGCTAFCYSGKETTSCLGFEYGGLINTLEAARRYQLKYFTPSSIGAFGISTPKVNTPQLTIQQPTTMYGINKVTGELLCQYYYVKFGVDTRSVRFPGLISHVKEPGGGITDYAVDMYFKAVRKGHYTSYINRYTYMDMMYMEDAIDAIIKLMEEDSVKLKTRNGYNLSAMSIEPEMLKQAIQVYYPDFTLDYDIDLERQDIALSWPDSIDTSCAQEEWGFDPKYDLPTMTKVMLEAIEKKQKEC

SEQ ID NO: 5272 - protein, 118 aa, Staphylococcus epidermidis
MEIAKMRVKNKYFSITPNVVEKMKEADINPDILRQRLASGWKFEDAIEAPLGVRRSEWDSLKPKEDGIASYKERMAQRRLQELKRKKPHLFTVPQKHPRSEWCTYLMENDIFPRKVAK

SEQ ID NO: 5273 - protein, 105 aa, Staphylococcus epidermidis
VMNAQDVKILNNLSLDDTSNDETIELLIEKYLNVAEEYCNQTFNRQSLPSNVEKFIANCIKQGTTSNISSRTMGTVSYTFVTDLPKETYGYLKPFRRLRWTGYHV

SEQ ID NO: 5274 - protein, 81 aa, Staphylococcus epidermidis
SSLAPVSGNLSFVFLSELLSNPESLSESESLSESESLSESESLSESESLSESESLSESESLSESESSLSESESLSESESSS

SEQ ID NO: 5275 - protein, 176 aa, Staphylococcus epidermidis
IMKAIPKIFDKEKGQWIELMAKPIAEEVVKIMKEDWLSNKKTIDYWLLQYTEGVVEPIQVAIFTDGNEVDEILKSNLEWMFNGYVSNLENKKLFNLQDFINYCYSTKTELPKQFKVNAIVKFDSLDEPIKLQEIDNITTNPDVLGILDETSEGSIEVKYIYNDHSIEDKKLIKENK

SEQ ID NO: 5276 - protein, 1185 aa, Staphylococcus epidermidis
ICLAGQVVQYGRHRKRRNYARISEVLELPNLIEIQTKSYDWFLKEGLLEMFRDISPIEDFTGNLSLEFVDYRLGEPKYDLEESKNRDATYAAPLRVKVRLIIKETGEVKEQEVFMGDFPLMTDTGTFVINGAERVIVSQLVRSPSVYFNEKIDKNGRENYDATIIPNRGAWLEYETDAKDVVYVRIDRTRKLPLTVLLRALGFSTDQEIVDLLGDSEYLRNTLEKDGTENTEQALLEIYERLRPGEPPTVENAKSLLYSRFFDPKRYDLASVGRYKANKKLHLKHRLFNQKLAEPIVNSETGEIVVDEGTVLDRRKLDEIMDVLETNANSEVFELEGSVIDEPVEIQSIKVYVPNDEEGRTTTVIGNALPDSEVKCITPADIVASMSYFFNLLNGIGYTDDIDHLGNRRLRSVGELLQNQFRIGLSRMERVVRERMSIQDTDSITPQQLINIRPVIASIKEFFGSSQLSQFMDQANPLAELTHKRRLSALGPGGLTRERAQMEVRDVHYSHYGRMCPIETPEGPNIGLINSLSSYARVNEFGFIETPYRKVDLDTNSITDQIDYLTADEEDSYVVAQANSRLDENGRFLDDEVVCRFRGNNTVMAKEKMDYMDVSPKQVVSAATACIPFLENDDSNRALMGANMQRQAVPLMIPEAPFVGTGMEHVAARDSGAAITAKHRGRVEHVESNEILVRRLVEENGTEHEGELDRYPLAKFKRSNSGTCYNQRPIVSIGDVVEYNEILADGPSMELGEMALGRNVVVGFMTWDGYNYEDAVIMSERLVKDDVYTSIHIEEYESEARDTKLGPEEITRDIPNVSESALKNLDDRGIVYVGAEVKDGDILVGKVTPKGVTELTAEERLLHAIFGEKAREVRDTSLRVPHGAGGIVLDVKVFNREEGDDTLSPGVNQLVRVYIVQKRKIHVGDKMCGRHGNKGVISKIVPEEDMPYLPDGRPIDIMLNPLGVPSRMNIGQVLELHLGMAAKNLGIHVASPVFDGANDDDVWSTIEEAGMARDGKTVLYDGRTGEPFDNRISVGVMYMLKLAHMVDDKLHARSTGPYSLVTQQPLGGKAQFGGQRFGEMEVWALEAYGAAYTLQEILTYKSDDTVGRVKTYESIVKGENISRPSVPESFRVLMKELQSLGLDVKVMDEHDNEIEMADVDDEDAAERKVDLQQKSAPESQKETTD

SEQ ID NO: 5277 - protein, 291 aa, Staphylococcus epidermidis
LIYYYSCSSFTIMDLATKYFNQINWRYVDHSSGLEPMQSFAFDDTFSESVGKDLSCNVVRTWIHQHTVILGIHDSRLPFLSDGIRFLTDEQGYNAIVRNSGGLGVVLDQGILNISLIFKGQTETTIDEAFTVMYLLINKMFEDEDVSIDTKEIEQSYCPGKFDLSINDKKFAGISQRRVRGGIAVQIYLCIEGSGSERALMMQQFYQRALKGETTKFHYPDIDPSCMASLETLLNREIKVQDVMFLLLYALKDLGANLNMDPITEDEWTRYEGYYDKMLERNAKMNEKLDF

SEQ ID NO: 5278 - protein, 256 aa, Staphylococcus epidermidis
HEYYCNRVTERSEIMAVFRVYKETGNFVTVHKNFIHDDNLSWKAKGILLYLLSRPDDWQIYESELVRHSTDGLSGLKTGIKELEKVGYIQRTRKRDDKGRLKEYEYAVYEKPNHIRFSNVGKTYIGKTYVGESHTTNNNSTNNDLTNNKNTNNVTDETSKSFQYISNNLEIIQSPLKAQQLEEAIKDFKDNKLEIVTVATDYCKENNKGINYLIKVLENWSKDGVDTKEKAISKVKPRNNKEDNYLAKKKQELLGG

SEQ ID NO: 5279 - protein, 274 aa, Staphylococcus epidermidis
NLYYNYNNDLFLILKKFGDEMNKDTIETSREALIKDVVMIAARILLESGAEGTRVEDTMARIATKLGYPESNSFVTNTVIEFVLHNEAYPRLYRIKTRDTNLIKISQANEISRQITNGTMTLEEAKYQLEEIYVAKRDSSLPFKGIAAAIIATSFLYLQGGRLVDIITAVLAGTIGYLVVEILDRKLHAQFIPEFIGSLVIGIISVIGHAFVPSGDLATIIIAAVMPIVPGVLITNAIQDLFGGHMLMFTTKSLEALVTAFGIGAGVSSILILV

SEQ ID NO: 5280 - protein, 501 aa, Staphylococcus epidermidis
IMYYFVGNNIGHKTAGIEKAMINRLNLFKAYHYQAKILLLAWNRYLTQTASQYINSEDYINMYDYFQEASNVTSVFSKNWIHYWRNECGYTIKPVSETNDVRIYDQQQFIMYAHFADEAYQKIDYINYFDTSRRKIKRELYDTRGFLSCVRVLSTDQKIQAEYYLSPQGNVKIEKYYDINSNHPYVAKKIILNHLGKTHFLNNETELGAFFIETIYQSSDLFFSDRNLVTSHIFNIVASYIPVIAVLHSTHVKDVTDLTHSPIKNVYKGVFEHLQRYKAIIVSTQQQKADVIERIRGVIPVYAIPVGYSSFEMNDDSNKNNYVSPKKIISVARYSPEKQLIQQIELINRLKDTFPNIELHMYGFGKEEQHLKERIQELGLEKHVILRGFLKDLTDEYQDAYLNLITSNMEGFSLALLECESHGVPSISYDIQYGPGELIQDGKNGYLIEKNNQHMLFEKVKLLLNNPQLQQSFSHHCIETAQKYSQTQIMLLWKNLLQHFN

SEQ ID NO: 5281 - protein, 72 aa, Staphylococcus epidermidis
VMLYSLYIRHPVNLVYWYLLNYTKRPYFLKYFNIKLHISTKYFGETLEGTGQAEDYRLKLSPKKASQQYEAL

SEQ ID NO: 5282 - protein, 331 aa, Staphylococcus epidermidis
IILYNTLNAWGGFIIMKYIDEQTQAQLLDMNEVILEVEKALQAFSENKTITPLRYVLPFNEQNRYLVMPALSDELNIVGLKTVSFAPENSKKGKATITGSVILSDYETGETLSILDGGFLTKVRTGAISGVATKYLAKENAKTLSVIGAGVQAEGLIEAILAVRDIEKIHIASRTFEKAEKFAQNIRNRFNIKVSVFRSADEAIDSADIVVTATNANQPVYTHSLHPGVHLNAVGSFKPDMQEIPSETMLVANKIVVESMEAALEETGDLKIPQAEGILTKNMLHSELGDIISGEKVGRETEEEVTVFKSVGLAIVDIIVAQYFYKKLIQS

SEQ ID NO: 5283 - protein, 127 aa, Staphylococcus epidermidis
WRKYKMANQEQIIEAIKEMSVLELNDLVKAIEEEFGVTAAAPVAAAGAAGGGNAAAEKTEFDVELTSAGSSKIKVVKAVKEATGLGLKDAKELVDGAPKVIKEAMPKEDAEKLKEQLEEVGASVELK

SEQ ID NO: 5284 - protein, 135 aa, Staphylococcus epidermidis
YLVYSKASILNMIDGYKMNCNILEDVVPECDSNSIAQYGIQATLPKPQGENGSKVEDVVIRLERTNKRYAQMLKEVEFINQSQQKLGHVDFCFLEHLKKGRRRDKIIEKMPNAKLNRNNFLARKDELAEKIYLLQ

SEQ ID NO: 5285 - protein, 125 aa, Staphylococcus epidermidis
IIHLDQYCYQLILCISLLFYQNLNHDNHGYHFDDHDCCDDNHHFYRNCLDSVDHYNYVHHDEYGRHLEYKVIHSRYHHVDYHIDVGDDAGHDDYLNAQNGYNLRHYNCDCSYVCHFDKHSYLCLV

SEQ ID NO: 5286 - protein, 171 aa, Staphylococcus epidermidis
WFFQTKITSILDANEHSTVYGKRGRERVYEERYRVHEEQLQRNHGRATLLDYSEIRQITSQYIGYLPYDELMSLTPNEWKDWVIGRRLALLDEQETLLFGAQANGLVQAGKSLKRLQKQLERARYEVRGQSDEYERMKKRKLAQNKRNREAQKQGTRRFMNSLRNTSQRGG

SEQ ID NO: 5287 - protein, 154 aa, Staphylococcus epidermidis
ECTHMFWIFNFIFSFLASLFFCVIFDAPRKLYFACGFVGACGWMVYTVLFNGFELHTIYSSFFGSLALGLLSHYMARRKKEPVIIFMVTGIIPLVPGGLAYDATKNLVLLHFGKAINTMLEVTLIAGAIALGLLFADQISKIVISGFARTRKRL

SEQ ID NO: 5288 - protein, 162 aa, Staphylococcus epidermidis
GRSHMYSVRQATEKDVVAIRDVATKAWYNTYLNIYAASTVNELLAASYNETHLKKRLNEQLFLVAEEDSEIVGFANFIYGEELYLSAHYVRPESQHRGYGTRLLEAGLKRFKDQYETVYLEVDNNNSNGIEYYQNHGFEIIRSYQPEMYGEIMDLALMKKSF

SEQ ID NO: 5289 - protein, 130 aa, Staphylococcus epidermidis
YVNQGKSKTKQSDSPALNRGFNSKKKQFTNLNSPQKRGVCTRVGTMTPKKPNSALRKYARVRLSNNIEVNAYIPGIGHNLQEHSVVLVRGGRVKDLPGVRYHIVRGALDTSGVDGRRQGRSLYGTKKPKN

SEQ ID NO: 5290 - protein, 312 aa, Staphylococcus epidermidis
LILHDVEVYKNKERLRISNNRFTGTALRVVSYDVKGAGYDRKFDEIDRVNGRFHNATKEEKKSISMTVRYDVEKIAYASHLKANIQAMLRGHFYLRELATSESEVKFENIFEPKEQSFELEYVDGRQILVGLVNEVSFDTTKTSGEFTLDFETIELPYFESIGYSTDLEKESGNLNKWGIPDKNPFNTSHKERRYTFYDTKVGDVYYGGTAEINQFNQDSVVEMTLGENVSKNDSDGFNFYMTHSDIMKISGLELRAGDVIKFDGIHVYRNNLRIDDYNKTKQQPVLMPGWNTFHTTKKLQKITFKHKRYYL

SEQ ID NO: 5291 - protein, 277 aa, Staphylococcus epidermidis
HMAQGTTTKSTQIVPEVLKPMMQAELDKKLRFAQFADIDSTLVGQPGDTLTFPAFVYSGDATVVPEGQKIPVDKIETNRREAKIHKIGKGTDITDEALLSGYGDPQGEAVRQHGLAIANKVDNDVLEALRGTKLTVSADIGTLAGLEAAIDTFDDEDLEPMVLFINPKDAGKLRSSASANFTRATELGDNIIVKGAFGEALGAVIVRSKKLDEGEAILAKRGAVKLITKRDFFLETDRDPSTKTTALYSDKHYVAYLYDESKAVKVTKGAGTTDSGA

SEQ ID NO: 5292 - protein, 246 aa, Staphylococcus epidermidis
ISMQIQPEFFEKLKPRYSDNGVFQLINTSILNAFGLNDKIRGEEMSHYYDEQPDVKSNPKRISYQIKNVQLELTTDAGVFSKDNVDFGSDLLIKTFLKEHPPGPSKTIADVGCGYGPIGLAIGKASPHHQITMLDINNRALALAEMNKTKNQVDNVTIMESDCLSAVNHQCFDYILTNPPIRAGKDIVHRIFEQAFDRLKTTGELYVVIQKKQGMPSAKKKIEELFGNVEIIAKSKGYYILKSIKG

SEQ ID NO: 5293 - protein, 600 aa, Staphylococcus epidermidis
IQTQCWDLPNYIFNRYWHFKTTGNAIAMAWYRYPKGFKFYRNTRNFVPKPGDMAVWGKGSFNNGVGHTAVVIGPSTKSYFTSVDQNWIGANSYTGSPGAKIKHSYNGISGFVRPPYHAETKKPSKPSSTPSKPSNDNTPKNTKEQTKPITKEITKVSYTSFAYDLDDDLEYIYHYMVEGQKLIGKVKGIYIKESTHMRSVEELYLQRNKYVNEDEYPHVYIDRERVWTPRPDSEEAPEHPGWLVMEVCGGQTDSKRQFMLNQIRALIYGVWLLSWSKVKLSESSIKADPNIWRSMKDLINYDLIKNGIPDESKYKEVEKKIIGLYLKRDKLLTETITTTTTKTKIKIKPKTSVDNPSQNDKSTGKTTNRTSNKPRVVVEKSKYTFQQALNAQMAHGMPQKSYSWGWGNASRSQTSKYMNPNTIWNSSTQRYQMLDLGKYQGISVSKLNKILKGKGTLSGQGKAFADGCKKYNVNEIYLIAHAFLESGYGRSNFASGRYGIYNYFGIAAYDNNPNASIGYARRQGWTSPRNGIIGGAKFVRKQYFNKGKNTLYRMRWNPSNPGRMQYATAIEWCNFQASTISKLYKTVGTKGMYYIRDKYR

SEQ ID NO: 5294 - protein, 180 aa, Staphylococcus epidermidis
RMAQNKYIAALQIADKDLASKLKEEDAILLASLAEGGHTISNDLAEMITGGKKDYGRNSVEEEIKLTVDRVPGDKGQEALKESVKNFKQLRLWIWEVKKRDGKHHGTFAYVIIEEQEWSFDDEDDKIEITAKVKFNSADGSVDSLPPEWLNPSAAAPTVEFEGMGEYTGTYEERTPSAGA

SEQ ID NO: 5295 - protein, 224 aa, Staphylococcus epidermidis
YNFNYEVNIMNFDSYIFDFDGTLIDTTTCHVKATQSAFKRLNLDEPTEQAILHTYHLNLYNNFKALASHELSFYQIEKLIDEYNHCFSNDEIHQSKEYTGISEALKFLHNQKKKIFVVSNKEILTTQKYLDYLGLSRFITDSLGVCIKNEDKLLCETIQNLIQKHHLMIGKTVYIGDTAQNIKSANQAHVQTCAVTWGAQSAHELLHENPHYIVNDPEEFLTIL

SEQ ID NO: 5296 - protein, 136 aa, Staphylococcus epidermidis
EVINVIWISFSSVIIVLVLCIFAIYKWIKAEKRVNELQEDKHGLQLDKLHLEREVSWLKNKDNKNNIGKYVVELKKGVYLVKKYIGSYGNTCIITDNVFEALSYDDLYSAKEDACSFNGRVLEHKPNLEVVKQCGA

SEQ ID NO: 5297 - protein, 336 aa, Staphylococcus epidermidis
ERIKEDIMADLLSVLQDKLSGKNVKIVLPEGEDERVLIAATQLQKTDYVSPIVLGNEDNIKSLASKHALDLTQIEIIDPATSELKDELVDAFVERRKGKATKEQAVELLDNVNYFGTMLVYTGKAEGLVSGAAHSTGDTVRPALQIIKTKPGVSRTSGIFFMIKGDEQYIFGDCAINPELDAQGLAEIAVESAKSAQSFGMDPKVAMLSFSTKGSAKSDDVTKVQEALKLAQEKAEADQLDHVVIDGEFQFDAAIVPSVAEKKAPGAKIQGDANVFVFPSLEAGNIGYKIAQRLGGYDAVGPVLQGLNSPVNDLSRGCSTEDVYNLSIITAAQALQ

SEQ ID NO: 5298 - protein, 64 aa, Staphylococcus epidermidis
VMANREETIEVEATIKVRCKYPVWVNNQITASDEKERILDLISKNPEKELMSEDFELVELIEVE

SEQ ID NO: 5299 - protein, 271 aa, Staphylococcus epidermidis
NEYKLIRFRQRNFFNVCFFCLFLFTQLRIRRDKMIYAGILAGGIGSRMGNVPLPKQFLSLQGKPIIIHTVEKFLMYKDFDEIIIATPQKWINYMLDLLNNYQLDDKKIKVIQGGDDRNHSIMNIIESIEQHKKLNDEDIIVTHDAVRPFLTNRIIRENVEYASQYGAVDTVVNAVDTIISSNDAQFISGIPIRSEMYQGQTPQTFKIKELKDSYLSLTQSQKEILTDACKILVELGKPVKLVKGELFNIKITTPYDLKVANSIITGAVDND

SEQ ID NO: 5300 - protein, 97 aa, Staphylococcus epidermidis
RMYKVIEYFEDLQDDNYEYNVGKTFPRKGLNVSDERLTELSTKENRQNKPLIERVESDKDLKGMKVSELRELAKEREIEGFSSMKKDELVEALGSVK

SEQ ID NO: 5301 - protein, 467 aa, Staphylococcus epidermidis
CKHNYIKCLQMVMKMKKIMEYLQHYINQYPHRLALVFEDRHLTYGELSKEIYQASMRYKEVKLNKKVGLMDEHPVNNIINYFAVHQRGGIPCIFNHQWSNERIHQLVKSYDIQWLIKDNHLTSNHDNSIYNDEVIPRNVIHIGFTSGTTGLPKAFYRNEHSWIVSFKENEKLLQHCEETIVAPGPLSHSLSLYACIYALSTGKTFIGQKNFNPLSLMRLINQLNKTTAIFVVPTMVQQLISTQRHCSSIKSILSSGAKLTLQQFQQIRNLYPQANLIEFFGTSEASFISYNFNQSSPANSVGKLFPHVETRLLNQDDDAVGLLAVRSEMVFSGYVGQSNQEGAWIKTGDFAYIKNQHLFLVGRESDRIIVGGINVYPTAIESLIMDIEGIDEALVIGIPHAKFGEIAILLYSGKVQLNYRQIKSFLMKHLSRQEVPSKLKKIDHMIYTESGKIARKEMKNKFINGEL

SEQ ID NO: 5302 - protein, 162 aa, Staphylococcus epidermidis
SMSKLFELKDSYQQVYDLIAEQEDEQILKDTLASINDAIEDKADGYVAVIKSLEADNNAIDEEIKRLRQRKTSNQNGVKRLKESLQEVMEQTGKEKFKTALNSYSIANNPPSLDVTDESLIPKQYYIEQKPKLDKKELLKAIKDGLELKGVELKQSRSLRVR

SEQ ID NO: 5303 - protein, 67 aa, Staphylococcus epidermidis
FKINRLNSSLFIFLSFGKRMIKKINPITNQIPKAMYDGIESAAGEPGISNKHKNTKDTIDPIIPKIL

SEQ ID NO: 5304 - protein, 141 aa, Staphylococcus epidermidis
KSVLLAKVKYGNWDLVKELEEFEKETIRWAKKGIAKTTTIIHNSIVSNMPVDTGYLRESVSMDFKKGGLTGVINIGSEYAVYVNYGTGIYVVGPGGSRAKNIPWRYKDADGHWHTTKGQHAQPFWEPAIDEGRAFFNKYFS

SEQ ID NO: 5305 - protein, 73 aa, Staphylococcus epidermidis
VKYKRNVGIYQTTFSIDIGILKQQEMRLLWHGIDILKASNSIGTLETLFRNLVTWQFGERAPLITVLGILLLS

SEQ ID NO: 5306 - protein, 317 aa, Staphylococcus epidermidis
MANNKDNPKITNQNDIDNYIDRLVNQANKEIETLFAKRLKEIKQIIANMYEKYDRDEPQVTWTEFNKYNRLNKELNRIGQMLSQDYREVAKAIKQSQQNIYIEKYMMSLFLYEVASQTSMNFDIPTTQTIQTAIEQPIEFIKLVPTLQKHRDDTLKRIRMHITQGIMSGEGYSKIAKALRDDLGMAKAQSVRVARTETGRALSQAGLDSAMVAKDNGLDMKKRWYSTKDTRTRDTHRHLDGTSVDIEDNFHSSGCVGPAPKLFVGVASAKENINCRCKLLYYIDEDELPTTMRTKEDGAIPFTTYREWEKDKRKGGV

SEQ ID NO: 5307 - protein, 80 aa, Staphylococcus epidermidis
KELKMNSRVITKENKKEIAHRIKQIRLQRNFDINEFAEILYVSPFSIKQWEEGKRIPNIKKIKLIAFVFKTTPEWLLYGE

SEQ ID NO: 5308 - protein, 111 aa, Staphylococcus epidermidis
KRINKIESTQCVGFLIYLKGDMSMKTDVGSIVRTIVFILAWVNQFLATKHISPIPVDEVTISSIITGAISLWTWWKNNNFSHAAQKGQQKLHEVKAGTENTNGKAPIGGND

SEQ ID NO: 5309 - protein, 125 aa, Staphylococcus epidermidis
RMVKIKKKVEMTLPELIEWAWKNGVKEKAFYSNIDRGSVYFDMVQTVSIEYSIVVDETFTVEVEEEVTEETKIPEMLEIFVNGGGVKRVEKSINELKDDFSKEFWLKDGDTMTLIWKDGELVGDE

SEQ ID NO: 5310 - protein, 67 aa, Staphylococcus epidermidis
IFTKIKILQMFWQIFYRRGKTMKNYDLIIIGFGKAGKTLAAHAASHGQKVAVVERSTKMYGGTCINI

SEQ ID NO: 5311 - protein, 461 aa, Staphylococcus epidermidis
LMTNKTRSQAHAYLDRLKGYWWDFDGVYGAQCFDLANQYWYYVTGHTLSGMYAKDIPFVNDFNGYANVVKNYNSYIPKKGTLVVFPYEYGNGCGHVAIIESATQNYFYSLDQNWYGGARNNPPEVAQTIYHEYHPDMYFVEPLYSKETKVSKIKAKTTKPKPVKKVKKRKVMIVAGHGYNDPGAIGNGYNERDFIRKNIVDNVSKYLKDAGHTVGIYGKKQDMYQDTAYGVRVGNHRDYGLYWVKSQGYDTVIEFHLDSAGPKATGGHTIIPAGYPANITDKNIQAALKQSVGTIRGITQRNDLLNCNVANDIGIEYRLVELGFITSYKDMKYINENIKPFTKSIASDINGKPIGGTSAGKVKSVKKTWDWKGRFYPNTTIKVRKKPNGEIVEKGSWLYGKDDWVDIVQLYKDTKKKLWWGKFKYPTNPSSGYFYCALGEITDKQERIKKEKKLYGKIKWQ

SEQ ID NO: 5312 - protein, 70 aa, Staphylococcus epidermidis
VHPLINNDILIESDIVVTLCSDADANCPVLPKNVTKEHWGFDDPAGKDWSEFQRVRDEIKAAIETFAHRV

SEQ ID NO: 5313 - protein, 196 aa, Staphylococcus epidermidis
KQQNNVEQLLKVNKMSEFNNYRLILEELDSTLSQVDNTEYERFANDVIGADRIFTAGKGRSGFVANSFAMRLNQLGKNAYVVGESTTPSIKEHDLFIIISGSGSTEHLRLLAEKAQSEGAKIVLLTTNAESPIGNLAETVVELPAGTKHDVEGSKQPLGSLFEQASLIFLDSVVLPLMDAFHISEKTMQENHANLE

SEQ ID NO: 5314 - protein, 930 aa, Staphylococcus epidermidis
LKKNNLLTKKKPIANKSNKYAIRKFTVGTASIVIGATLLFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 5315 - protein, 99 aa, Staphylococcus epidermidis
FMKKIIITGALGQIGTELVIKCRERYGTENVLATDIRKPEPHSPVKNGPFEILDVTDRNRLFETVRYFNADTLMHMAALLSATAEKKPLVAWDLNMGDL

SEQ ID NO: 5316 - protein, 73 aa, Staphylococcus epidermidis
GKEKSILVPSLLLKKLIFDENTNLITEKIGDDNNITCNLIKVVFYLYCIHNKINIYFEYLENSLNSRITIDII

SEQ ID NO: 5317 - protein, 164 aa, Staphylococcus epidermidis
NVRNHIYSQCLKNTLVVNGVRTLWKMTSSLERLRNDMNIKLIKEKIDNENKRMGSELEYTFKYKGHKCKVKRIEEYGHLCGYIYLNVKRGSEEYEIIDELAHCGVSYHKGNLIGFDCAHAGDFSLRMYNLFENKTYLSDLETYKDLEYVENNIKEIIDSLQKGG

SEQ ID NO: 5318 - protein, 187 aa, Staphylococcus epidermidis
NVGKQRKMTYFKWQDKHVKFLKENANGNNSEDLTQSFNNRFGTNQSKSSLKSKMYQIGIKFNNNTGRFKKGDHSYNTYAIGTKSIDKDGYVIIKHSNSKGDYNKNWKLYHHYLWEQKHGRIPEGYVVIFLNGDNRDFRIKNLYCVERGVWLKVINNDMRFDNPELVESAIHLSKLMIKQKNIEKRRR

SEQ ID NO: 5319 - protein, 1215 aa, Staphylococcus epidermidis
SKLKEVGSLIDVNNFHYMKIGLASPEKIRSWSYGEVKKPETINYRTLKPEKDGLFCERIFGPTKDWECSCGKYKRVRYKGMVCDRCGVEVTKSKVRRERMGHIELAAPVSHIWYFKGIPSRMGLLLDMSPRALEEVIYFASYVVVDPGPTGLEKKTLLSEAEFREYYDKYPNQFVAKMGAEGIKDLLEEIDLDEELKELRDELESATGQRLTRAIKRLEVVESFRNSGNNPSWMILDVLPIIPPEIRPMVQLDGGRFATSDLNDLYRRVINRNNRLKRLLDLGAPGIIVQNEKRMLQEAVDALIDNGRRGRPVTGPGNRPLKSLSHMLKGKQGRFRQNLLGKRVDYSGRSVIAVGPSLKMYQCGLPKEMALELFKPFVMKELVQREIATNIKNAKSKIERMDDEVWDVLEDVITEHPVLLNRAPTLHRLGIQAFEPTLVEGRAIRLHPLVTTAYNADFDGDQMAVHVPLSKEAQAEARMLMLAAQNILNPKDGKPVVTPSQDMVLGNYYLTLERKDAVNTGAIFNDTNEVLKAYANGYVHLHTRIGVHANSFNNPTFTDEQNSKILATSVGKIIFNEIIPDSFAYINEPSQANLERTTPDKYFVDPTQLGEGGLKEYFDNAELIEPFNKKFLGNIIAEVFNRFSITDTSMMLDRMKDLGFKFSSKAGITVGVSDIVVLPDKQDILDEHEKLVERVTKQYNRGLITEDERYNAVVEIWTDAKDQIQGELMQSLEKTNPIFMMSDSGARGNASNFTQLAGMRGLMAAPSGKIIELPITSSFREGLTVLEYFISTHGARKGLADTALKTADSGYLTRRLVDVAQDVIVREEDCGTDRGLLVSDIKEGTEMIEPFIERIEGRYSKETIRHPETDEVIIRPDELITPDIAKQITDAGIEQMYIRSAFTCNTRHGVCEKCYGKNLATGEKVEVGEAVGTIAAQSIGEPGTQLTMRTFHTGGVAGSDITQGLPRIQEIFEARNPKGQAVITEIEGVVDDIKLAKDRQQEIIVKGANETRSYLASGTSRLKVEIGQSVERGEVLTEGSIEPKNYLSVAGLNATESYLLKEVQKVYRMQGVEIDDKHVEVMVRQMLRKVRIIEAGDTKLLPGSLVDIHNFTDANRDAFKHRKRPATAKPVLLGITKASLETESFLSAASFQETTRVLTDAAIKGKRDDLLGLKENVIIGKLIPAGTGMRRYSDIQYDKATAPVTETSEEVETIE

SEQ ID NO: 5320 - protein, 218 aa, Staphylococcus epidermidis
KRMKWSEVFHDITTRHDFQAMHDFLEKEYTTQTVYPDKQNIYQAFDLTPFEDIKVVILGQDPYHGPNQAHGLAFSVQPHAKFPPSLRNMYQELENDIGCHRTSPHLQDWAREGVLLLNTVLTVRQGEAHSHRNIGWETFTDEIIQAVSNYREHVVFILWGRPAQQKERFIDTSKHLIIKSPHPSPLSAFRGFFGSKPYSTTNNYLKSKGKTPVQWCES

SEQ ID NO: 5321 - protein, 75 aa, Staphylococcus epidermidis
TMMKMTTSTLELSSTINQRYKYNTQGKTPTQIQQELRQIGVKGFVVKVAGSRVTMKVEKENIRKNRECMRNGRSN

SEQ ID NO: 5322 - protein, 460 aa, Staphylococcus epidermidis
GVMNYERSYLRSCQVRTLEQKEVGYSIEEQERKLKSFCEINDWSVSDVFIDAGFSGAKRDRPELQRMMNDIKRFDLVLVYKLDRLTRNVRDLLDLLEVFEQNNVAFRSATEVYDTSTAMGRLFVTLVGAMAEWERETIRERVMMGKRAAIKQGMILTPPPFYYDRVDNTYIPNDYKKVVLWAYDEVMKGNSSKAIARKLNDSDIPPPNGKRWEDRTITRALRNPITRGHYTWGDVFIENSHEPIITEEMYQQIKERLEERINTKIVSHVSVFRGKFICPRCGGTLTMNTATRKRKKGYVTYKTYYCNTCKTKKQSFGFSENEALRVFRDYLSKLDLDKYEVKTKQKDDVVTIDIDKIMEQRKRYHKLYAKGLMQEEELFELIKETDETIAEYEKQKELVPRKSLDIDKIKKFKNALLESWKIFSLEDKADFIKMAIKSIDIDYVKLKNRHSIKINDIEFY

SEQ ID NO: 5323 - protein, 60 aa, Staphylococcus epidermidis
RKVKFMITVLVITIFFITVTLIIWQPKGLDIGISAVIGALLAIVTGVVSVSDILEVTSIV

SEQ ID NO: 5324 - protein, 286 aa, Staphylococcus epidermidis
KIKNNKWRMETMTELNTKEMKLDALLKDMQSVVIAFSGGVDSSLLLKKAIDILGVNYVKPVVVKSELFRNEEFELALKLGQSLGVEVLETEMSELQDANIVKNTPESWYYSKRLMYSQLENIKNKLGFNYVLDGMIMDDLDDFRPGLKARDDFGVRSVLQEAKLYKSEVRELSHQHDLPVWNKPALCSLASRIPYGEELSFTKVNKVNEAEKFILSLGINHVRVRYHHNIARIEVTEDQLNNLLKLKDSIILHLKELGFDYVTMDLEGYRTGSMNEIIDTKSTSFK

SEQ ID NO: 5325 - protein, 164 aa, Staphylococcus epidermidis
KKEKCRMKEPPHNRLTFKESMTEGKYLTTITKEDKIRYKKLSVEEKRKVLNDFNASTPQKDDKVSLFDYMKRTMLKHGLDEVTSITENAVLKNEPGKHIDSFMTRLSSFSTTKDGTTVFTYELINQNFVVIKILDEQLKQNKKIIEQNNEIISLLKQIANRGEM

SEQ ID NO: 5326 - protein, 300 aa, Staphylococcus epidermidis
NKWKRGQLMIKLIATDMDGTLLNAGHEITTMNQEAIKFAQANGITVVIATGRAFYEAQTPVAETDLKVPYICLNGAEVRDESFNIMSTSHLNHDLVHKITTALKNNHIYYQIYTNRGIYTEDPKRDLAIYIDIAERAGQKADVDKIRNNIQKRIDNGTLKVVDNYDSIEDIPGELIMKVLAFDADLSKIDQVGQALASSPNLAVSSSSRGNLEITHSNAQKGIALSAIAHQLGIDLTDVIAIGDNLNDISMLERVGYPVAMNNATDEVKHIAKYVTDTNENSGVGKAIMKILKEENNLEV

SEQ ID NO: 5327 - protein, 139 aa, Staphylococcus epidermidis
ATVETTRENQLATVFQILVTAPEIADQIWFQLVMLVPSILFKTLNMKLEIWFQIDNMVFQMVFITFCVIVCNVCHAPGMSPDKSCIHAVANPMNNCDAACRIPPIAVNTTETIVHRYWNAITTPLIRLMNKKPKTWLAT

SEQ ID NO: 5328 - protein, 165 aa, Staphylococcus epidermidis
RMTENTINPITTLEFNGEEVEAKATFLFDKTAKKFAKDEQDKNGKTTKVSGFNAIYNGILERDTNAIADFWECATAYLNKKAPTREQIETSLMQFIDKNGDTLELLQGALDVMNNSGFFKQKSRQFWTQMNIAPSMAKEEEKESTKNGIEFMKNNYKEIMGELPY

SEQ ID NO: 5329 - protein, 86 aa, Staphylococcus epidermidis
MSNEKVARFNKQQYVVGLKETLKALKKGQVTSLIIAQDVEVHLLTRVLSYINHKNIPVSFFSSQRALGKYVGINVNATIVALISEN

SEQ ID NO: 5330 - protein, 406 aa, Staphylococcus epidermidis
NNNDILISIIKMEEVIHVFDWFQLASNKEKRMVQLRRYLHQYPELSFEEKRTHDFIVNQLSQLACTIETPVGRNGIKATFKGSDSNGPTIALRADFDALPVQELNDVPYRSKNKGCMHACGHDGHTAILLGVAEIVHEHRHLLKGNVVFIFQYGEEIMPGGSQEMIDDGCLQNVDKIYGTHLWSGYPSGTIYSRPGAIMASPDEFSVTIYGKGGHGAKPHETIDPIVIMAEFILSAQKIISRTIDPVKEAVLTFGMIQAGSTDSVIPDTAFCKGTVRTFDTKLQSHVQNKMDKLLQGLSLSNDITYELEYIKGYLPVHNHQQSYDVVKQAANDLHLRFNESDLMMIGEDFSHYLKVRPGAFFLTGCGNKDKGITAPHHNPHFDIDESSLKYAASEFLKILEIENVF

SEQ ID NO: 5331 - protein, 165 aa, Staphylococcus epidermidis
KNSDFGKSVDWAIQGTDARNGVMQETKDELDSDNLDKYSLKESADQDQFKKIQSAFKQQEPIVFTAMEPSWFSKELDVKMLKDPDNIYGNNNQHIDLVFNKDFKEAHPAAYTVATRMADDWSKSDEDKLAKKIFVDNKNPEQVAKDYVDDNDNKVDEWLEGIETI

SEQ ID NO: 5332 - protein, 120 aa, Staphylococcus epidermidis
NHLDVYVGLVIMFNPLDEFPHTIELGSREVVGEYPREQERFKSEKTIQGFMDTPTSSEQLKFHQMNQSYDRNLYTPYSLPITNTNLFKYNGKTYEVVGEPVDQGGQQEINLTRLKECPIG

SEQ ID NO: 5333 - protein, 293 aa, Staphylococcus epidermidis
NMTEFDLSTREGRWKHFGSVDPVKGTKPTTKNEMTDLQSTHKNFLFEIEEVGIKNLTYPVLIDQYQTAGLFSFSTSLNKNEKGINMSRILESVEKHYDNGIELEFNTLHQLLRTLQDKMNQNAAGVDVSGKWFFDRYSPVTNIKAVGHADVTYGLAIENHTVTRKELTIQAKVTTLCPCSKEISEYSAHNQRGIVTVKAYLDKNNDVIDDYKDKILDAMEANASSILYPILKRPDEKRVTERAYENPRFVEDLIRLIAADLVEFDWIEGFDIECRNEESIHQHDAFARLKYRK

SEQ ID NO: 5334 - protein, 109 aa, Staphylococcus epidermidis
GMAEVTKEQLLEFIRNNELDLDESYPRSDWWKFRNERDSLRKQRDELINDMAETKRKAEAFDEIVKVLASISKEIVEYPGDNDKQKEVIYKRYDDLFEPMKLLEVNDER

SEQ ID NO: 5335 - protein, 83 aa, Staphylococcus epidermidis
FLQENAEVLWMKVYEYQQLLGFMYREDYKEDPIIAKILIESGWAVKRLLDTGTIKPFDDYEEVKELIMNETKWRQPDGTYRRT

SEQ ID NO: 5336 - protein, 183 aa, Staphylococcus epidermidis
MTKELEIKLLTENATMPKRDRLDAGYDIYSAETVILEPQEKATIRTDIAVNIPEGYVGLLTSRSGVSSKTHLVIETGKIDAGFQGNMKINIKNDIEVVDADEFIYKDIKNEIIDDGSFNEPIEEQSSNPLDIFKPRNTSYVIKKGDKLAQLVIVPIWTPELKEIEEFSSGSERGEQGFGSTGF

SEQ ID NO: 5337 - protein, 83 aa, Staphylococcus epidermidis
TMKDKDYKSLWIKLKEKKLKEYVEVHRSVNQIITPYNQYHLFEIANEMVSENELKRDLKYMDQLDGTHEFQNLLSDLEACNGQ

SEQ ID NO: 5338 - protein, 208 aa, Staphylococcus epidermidis
MTEETLFNQLNQKDVNDHVEKKNGLTYLAWSYAHQELKKIDSNYSIKTHEFVHPDVPLDNYFVPYLATPEGYFVQVSVTVKGQTETEWLPVLDFRNKSLAKGSATTFDINKAQKRCFVKAAALHGLGLYIYNGEEVPSANDNDITELEERINQFVTLSQEKGRDATLDKTMRWLGIQNINKVTKKDIANAHQKLDAGLKQLDKENSND

SEQ ID NO: 5339 - protein, 212 aa, Staphylococcus epidermidis
ISLELQLAIDLLNKEEAAKLAQKVEEYVDIVEIGTPIVINEGLPAVQHLNENINNAKVLADLKIMDAADYEVSQAVKYGADIVTILGVAEDASIKAAVEEAHKHGKALLVDMIAVQNLEQRAKELDEMGADYIAVHTGYDLQAEGKSPLDSLRTVKSVIKNSKVAVAGGIKPDTIKDIVAEDPDLVIVGGGIANADDPVEAAKQCRAAIEGK

SEQ ID NO: 5340 - protein, 116 aa, Staphylococcus epidermidis
FIQEILKMRNNDEIITIIKSAMKEQDMSLSELARRVGVAKSAVSRYLNLTREFPLNRTEDFAKALSISTEYLLGFDKSEQQDEQPKHRAAHLEGELTDEEWQRVLDYADYIRSKRK

SEQ ID NO: 5341 - protein, 167 aa, Staphylococcus epidermidis
LTEEKCRMKKVLFLIFASLLVLGACGQDEDKNKEDDAKKVEVKKTKENKKDKQSQSKEQKQEKPYNNDDEPILNDNRNANDNNSNQRNNKQNQNVDKIDNNAYNQQQNGQVNQKENTENGLDPNFVRHNDNMVKEWQNQMREHNENFNPESGGDLYNVETGNYVDDE

SEQ ID NO: 5342 - protein, 437 aa, Staphylococcus epidermidis
DRRESMTLSSYATSKLTEEKVFKDPIHRFIHVQDQLIWDLIKTKEFQRLRRIKQLGTLYLSFHTAEHSRFGHSLGVYEIVRRMIDETFIGQDAWDNTDRPLALCAALLHDLGHGPFSHSFEKIFNTDHEAFTQAIITGDTEVNGVLSRVSDNFPKQVADVINKTHDNKLVISMISSQIDADRMDYLQRDAYFTGVTYGSFDMERILRLMRPSKEEVLIKDSGMHAVENFIMSRYQMYWQIYFHPVSRGGEVLLNNCLKRAKQLYNEGYEFKMYPKDFIPFFEGTMTIEQYVELDEAVVLYYLKKWIHENDTILSDLSRRFINRDLFKYIPFDGSIITISELQELFEAGGINPDYYFVSEAFSDLPYDYDRPGSNRKPIHLLKSNGGITEISNQSLVINSITGINREDHKLYYPKEMILKIKDYQIKGSIINLLNELN

SEQ ID NO: 5343 - protein, 344 aa, Staphylococcus epidermidis
GGLFMKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 5344 - protein, 124 aa, Staphylococcus epidermidis
WKSLYRKVGSKMKNKFLICDECQAVNLKSLKRKLEKLDPEAEIEIGCQSYCGPGRRKTFAFVNNRPLAALTEEELMEKVTKQLKKPRDPEEEERLRKRNEERKRRKEEQDRKLKEKLKKHKAEK

SEQ ID NO: 5345 - protein, 191 aa, Staphylococcus epidermidis
NATLTFVAVILISLILDEIGFFEWSAIHMVKASQGHGLKMFVFIMILGAIIAAFFANDGATLILTPIALAMIRNLGFNKKLVFPFIIACGFIVYSTSLPLVVSNLVNIVSADYFGIEFVEYLKRMFIPNLFSLLASILILWFYFRKSIPKTFDISSIFEPKNAIRDTRLFKISWIILALLLIGYLVSEFIP

SEQ ID NO: 5346 - protein, 283 aa, Staphylococcus epidermidis
LSFCLYILIWMHNFSHEGCAFFLIQIKIIGGIKMKKTAIITGSSRGLGAKIAITLLEKGYNVVVNYKQNKDKAEKLIRNYNQSRAIAIQADVTDRNDVNRMIQTATQHFGKIDIVINNALVGFKFDPNQQKSFKDLTWEDYQQQLNGTLKGAFNVTQSVIPQFIEQQSGCIVSIGTNLYQNPVVPYHEYTTAKAGLIGFTRNIAAELGQYGITANVVSGGLLKTTDASAVTTPEVFDLIAQTTPLRKVTSPQDVANMVVYLASDEARGVTGQNITVDGGLTMN

SEQ ID NO: 5347 - protein, 83 aa, Staphylococcus epidermidis
LWRLLANNRHPMPLNLNCYSSDKDLFRIKLVEELPLNKTLTFKFITTRKNITYKIKDFKLPQYRRSFHRKLKHHKKVSNKNKD

SEQ ID NO: 5348 - protein, 75 aa, Staphylococcus epidermidis
TERWCLIMEFNVKVNVDADEAIEKLERIKKLYEEINQLKNDRPVVKVGISNEADVEQIRSYINEKNVENANFNLF

SEQ ID NO: 5349 - protein, 172 aa, Staphylococcus epidermidis
EVSRLSEKKGFNFNIIKNDPLDGHKGTNIGSISLDNIAPVFIDVENQKAFVDIGGMHARAEVEKGVKWITDKSQVEGEEAKAYWLCWVTTERSEEGPYYAGVTACYLLVNKSIRRGYKSMPEHVNMMDKSMKHQFIIDQIGDDNKQILKEFLQNHNVEMWNNSSEELYRAFE

SEQ ID NO: 5350 - protein, 157 aa, Staphylococcus epidermidis
IMPRKGSVPKRDVLPDPIHNSKLVTKLINKIMLDGKRGTAQRILYSAFDLVEQRSGRDALEVFEEAINNIMPVLEVKARRVGGSNYQVPVEVRPERRTTLGLRWLVNYARLRGEKTMEDRLANEILDAANNTGGAVKKREDTHKMAEANKAFAHYRW

SEQ ID NO: 5351 - protein, 901 aa, Staphylococcus epidermidis
KLLRFLWLRRSKTLKLDNLITKLHSYFSQKFVSQLENNFEQIKYWTNKSDDSFNEHLTTQKNAHTTDQIKHKTTKGKDVVLSNHENYQDELIEHLVLGHNGDGNNELKASHTSMDAQSFDSLHQRLYHDFLRESNAREELRADLTKKIQRIVNVDDFGGDPTGQKDSTKAFQDALGNGNVQVTMSGGTYLTTGIKMPNNSRLVGQGKDITTIKFMDETPAENIGITNLKMSGGAENISLESFSFNGNKFRQNKTLKATGGSRSSNIRFAGVTNGYIYNVKSYDALLHCIDVTYANDNYYYEGDGNRVPYALESKHIHIDNCEVYGCGDDGITTHHSRYITISNCYAHTPTGGSNNNGVEIDDGSQYVFLSNNRTKGNFGGLEIKAHSNASAASGVFVNGHVSIEDTRAYNIRHIGHHRAKTDNKSLTAYDVVLNNCLALNPKYNGVYPGSTPRALLISAYRNVSVNNFTAIGDSDFGKLEGGKLDKKQPAIAIQFMSENISLNNINVRNFKNAEVDIRLFGGDNRPSRVSLNNINIWNSSNNIGIGVGSKIYDTKITNCNLHGNGSGIGLRLTNNHAMISGVTADNYSTSAWIAGEKYDTPPTVGKGGASIASTGSAGVANASAVIASTGGSKAYSNRSFVLGSGANSKSYGSRSGIINSLNSETDKKGHTQLIMNSNRVKSPGNYHVVAGYGSSGNASTSNIKFDLSTYSGNLTLAGQLKQDSADIAELFESQNGLAIDLGTIVTLDGDKIRKAQPNDTPIGVISGTAALVANEKTFHHKDRFLKNEYGVTITNRKQVEFVDDEGNVSFEWRDIPVENPEYNDKIDYQSRSERPEWNVVGLLGQIYTNIEKDVIPGDYINGRAGVGYKDNVNGKGRVMKITSEYTEERGCAIALVLWGAK

SEQ ID NO: 5352 - protein, 133 aa, Staphylococcus epidermidis
IHQRGLIQIIFTVNMNGRSDEMKVVYLWKNGQAIIVHKNEEDEYVYPDEKWTENQPPQGIILPCYYDGKQWVGQTQDELEKMLPEVEIPVDDKDIAIAKLTSLVVDLQEEVMSLKQNIALITEEQANQKLGEA

SEQ ID NO: 5353 - protein, 121 aa, Staphylococcus epidermidis
EMQLYLKDGMEIREVQFTNEEVQNYCELLNIKYDHYVPTLMCAKLWPQFELFQSFSKKPIILKETHIKTQHQLQVDCTYEATLHKVSQKLIKNIIKYTYGLEINKDKKHCMYIKQIFIEVR

SEQ ID NO: 5354 - protein, 168 aa, Staphylococcus epidermidis
LSIRSKYLDLKIIIRFNVTNEVTLRWVKMNLEFNIAVHVLCFLAQHDQEQFNSKELAKLTCLNPVQLRRVLAYLTEHNYIKVQRGKAGGYQANQHTAQVDLAKLYQHFVLDKNNSQRRFTGASDSHCQISKKIAHTMSHYYSQEHQIILDFYKDKNITDVLADILQEG

SEQ ID NO: 5355 - protein, 362 aa, Staphylococcus epidermidis
GRDRMIQVKAPGKLYIAGEYAVTEPGYKSILIAVNRFVTATIEASNKVEGSIHSKTLHYEPVKFDRNEDRIEISDVQAAKQLKYVVTAIEVFEQYVRSCNMNLKHFHLTIDSNLADNSGQKYGLGSSAAVLVSVVKALNEFYGLELSNLYIYKLAVIANMKLQSLSSCGDIAVSVYSGWLAYSTFDHDWVKQQMEETSVNDVLEKNWPGLHIEPLQAPENMEVLIGWTGSPASSPHLVSEVKRLKSDPSFYGDFLDQSHACVESLIQAFKTNNIKGVQKMIRINRRIIQSMDNEASVEIETDKLKKLCDVGEKHGGASKTSGAGGGDCGITIINKVIDKNIIYNEWQMNDIKPLKFKIYHGQ

SEQ ID NO: 5356 - protein, 705 aa, Staphylococcus epidermidis
YLFSKYWKEKKYMARDFSLKNTRNIGIMAHIDAGKTTTTERILYYTGRIHKIGETHEGASQMDWMEQEQDRGITITSAATTAQWQGHRVNIIDTPGHVDFTVEVERSLRVLDGAVTVLDAQSGVEPQTETVWRQATTYGVPRIVFVNKMDKLGANFEYSVSTLHDRLQANAAPIQLPIGAEDEFEAIIDLVEMKCFKYTNDLGTEIDEIEIPEDHKERAEEARAQLIEAVAENNDDLMEKYLGDEEISVDELKDAIRQATTDVEFYPVLCGTAFKNKGVQLMLNAVIDYLPSPLDVKPIIGHRANNPDEEVVAKPDDSAEFAALAFKVMTDPYVGKLTFFRVYSGTLSSGSYVKNSSKDKRERVGRLLQMHANSRQEIDTVYSGEIAAAVGLKETGTGDTLCGEKNDIILESMEFPEPVIHLSVEPKSKADQDKMTQALVKLQEEDPTFHAHTDEETGQVIIGGMGELHLDILVDRMKKEFNVECNVGAPMVSYRETFKQPAQVQGKFSRQSGGRGQYGDVHIEFTPNETGGGFEFENAIVGGVVPREYIPSVEQGLKDAMENGVLAGYPLIDVKAKLFDGSYHDVDSSEMAFKIAASLALKEAAKKCDPVILEPMMKVTIEMPEEYMGDIMGDVTARRGRVDGMEPRGNAQVVNAYVPLSEMFGYATSLRSNTQGRGTYTMYFDHYAEVPKSIAEEIIKKNKGE

SEQ ID NO: 5357 - protein, 69 aa, Staphylococcus epidermidis
VIYSSQKRTNGGENMVLNLKRLRAERIACGITQDEMAQMMGWKKELHMLKEKTGLWILELMSLLKWLKY

SEQ ID NO: 5358 - protein, 81 aa, Staphylococcus epidermidis
LCNRTCFLIYLLNTRYFHQQFFQSVAFSNDVKLLMVPNVGITCYIIKCNILNMLNLRYRFNVIAHKTSAHYPYFKRYKLMK

SEQ ID NO: 5359 - protein, 60 aa, Staphylococcus epidermidis
GVSRLIKRILKIWFTIAMYELGKWIGREVYYKLTANDEVEVPKDFDENDHAHLNGIYGGY

SEQ ID NO: 5360 - protein, 213 aa, Staphylococcus epidermidis
RLIRSGQMDIVGMQFNYLKVLEFYGRNKHKKKLYKCYCTRCGNKKIMIGTEVKNGYSKSCGCLNKVSHSKKHGMTGTLIYNKWKGMKQRCYNSNYDFYSAYGGRGIKVCDEWKDDFMQFYKDMGDVPFEGAELDRINNDDDYKPSNCRWVSHEENANNRRKYHNKTGYTGVTYKPHLNKYQAQLYKNKKFIYLGVYETAEEAHLAYKKAKNEY

SEQ ID NO: 5361 - protein, 89 aa, Staphylococcus epidermidis
MKRSGGNQMGLIDGLKKQYTLYQIDGWKMCSVTPLGEDTFKLGNYAGIHFRNTFSGTVTKDELEKLKRKHKLFRKEELQQQMTINELLF

SEQ ID NO: 5362 - protein, 69 aa, Staphylococcus epidermidis
MKRSSYLRRQSNLIISMIIFVIFLIVDINVLINKHQVVPVLLSSISLIIFIMLFVVALFKCITNYKHQS

SEQ ID NO: 5363 - protein, 260 aa, Staphylococcus epidermidis
VPMSHSYNSIEEVLKAVKSNQLSINDAKAQLSHYDELGFAKIDLHRAQRQGFPEVIFGQGKTKEQITKIISSLIFHNEVILVTRVDEMKAKYILQHYPNLEYHQTAQLISTPLKDIPQSKYYVSVLCAGTSDLPIAEEAALTAEIMGVSVKRFYDVGVSGIHRLLSNIHDIRRGKVSIVIAGMEGALASVVGGLVNHPVYAVPTSVGYGANLNGVTTLLSMINSCAPGTSVLNINNGFGGGYNAAQIIHMLENKESEVSL

SEQ ID NO: 5364 - protein, 65 aa, Staphylococcus epidermidis
VIWRLAMDNREFIQRCIVSSTAFTGHDGCLLIKELNEVYRKAELYDKIVENNSKSLVENGGTIND

SEQ ID NO: 5365 - protein, 1040 aa, Staphylococcus epidermidis
SKRRLAMNKNFMARISAIITDFQRNIRKAQRMAKTEIPDEIETQVDANISKFKRALNTAKAMAQRWREHTVDIDGNANPVKRAIAVVREKLQQLRDKEVDIKGNNNPLKRSVLGAKAMLATLHDKTVHVNFDTRGMTRAQVLTRALGQSLDEYGDKMDALATKIRTFGTVFGQQIKGMLIASFQGLIPIIAGLVPAIMAVANALGVVAGGALGVAGAFGIAASGAFAFGAMAVSAIKMLNDGTLQATAQTRRYQASLEQVKSTWEGIIKQNQAQIFNTLSNALDTVNVALGRMKPFLAGISKGMEQASQSVLKWAQNSQTASKFFNMMNTTGVKTFNTLLSAAGRFGDGLINVFTQLGPLFLWTAKGLDNLGKKFQNWANSVAGQNAIKSFIEYTQTNLPKIGQIFGNVFMGIGNLMKAFAQNSSNIFDWLVKMTAKFREWSEQVGKSEGFKKFVQYVQENGPVIMDLIGNIVRVLVAFGTAMAPIASVILKVVTALAGFIAKLFETHPAIARMVGIGMILGGMLWALLAPIIAVSTVLSNVFGVGLIQAIGKMLAFARNTQILRSALNLVKIAFRLLMSPISTIMRILPMLSGAFQALGVAIGAISWPVLAIIGVIVALIGIIVWLWKTNENFRKTCIEAWNTIKDTIMNAVKSVINWFNQFRASIQQTLQPIIPILQMLGQVANQVLGFLFISLINGVVMAFQYLWTIVSVVFTAIGGILQAASQLFIGLATAWIQLLSGDIPGAWQTLQTMTQNVMNTIWNTILSIWNQISNFIFNVLNRILGTNITSWNQIWSAISGAVTRIWNTVASWFSRVVSTVAQKMMQALSRIISGGAQWVSSIISAMSRFLQAVVSGFFRVVGAVGNGMRNALNRARSFIGHFYQVGVDMIAGMIRGIVQKAKDLAAAAWNAAKGALNAAKSALDSHSPSRKFIQLGNDSMTGLGMGISEYAGKAARESKLAALKVMDAFNADLKPDFLEEGLAGLGNSFDAHMSKDVRHSMQENNKPIVNVTVRNESDIPAIKSYIEDSNSKDASFGLF

SEQ ID NO: 5366 - protein, 128 aa, Staphylococcus epidermidis
EETGTIRRLDIMSMTELEAIEILELINNVYDMKFNEIKYNLWVEQLTQYGDFDRTLHKTKKYVRESRYKPTISQIIDRKPPEMESAVIPEEQTDKYRMQHDKEFREKRQQLRKQWQKMKEDWGLDDEY

SEQ ID NO: 5367 - protein, 232 aa, Staphylococcus epidermidis
EVGGLNVIYMYEPFTHTVTKTDLSHLHNITGIPLNTLWYQKERGTYNDKLKCFFTDTMPRVNKKQVFNESVVAKDEIWKYSEKYDLYVSNLGRMKRPDGKYKFANGCNGISTVIYKNKKYRAADIVYETFIGNLRTGYHAYPKDSRYNNLMADNLFQSTLQKYRVYRRNKGISKPVYLVDNNNRIVEEFASTVEAQKLLFIDRRNIARKCNRKHVSDGLMYMWADEYEELNA

SEQ ID NO: 5368 - protein, 67 aa, Staphylococcus epidermidis
RGKGGINNMIIYRRNIENGTPIYEIITKTFKTITIKCDETFNKYEIYQLLSLLENDVDNMPTSYSYR

SEQ ID NO: 5369 - protein, 398 aa, Staphylococcus epidermidis
GIFMTKALYLDCHAGIAGDMLLSALVDLGANPEDIESELKKLPLDQFKLHFQKRVKQGIHAMTLNIDVKEANHHRHVNDIFKMIDDSTLPERVKYRSKKIFEIIGQAEAKIHGMSFEEVHFHEVGAMDSIIDIIGGCIALEQLGINTLYCSAIPTGHGKINIAHGIYPIPAPATAEILKGIPIAHFDVQSELTTPTGAAFAKGLVSSFGPFPSATIQHIGYGAGSKDFDFPNILRVIQFESEFEQQDSVQVIECQIDDMTPEALGYFMNNALEQGALDAYYTPIFMKKSRPSTQLTLICKLHDKTYFEQLILQETSSLGVRSTSVNRKTLNRAFKILSTQHGTVSIKFGLQNGKIMKMKPEYEDLKKIAKTTKQPFQVIHNEVLQQLYQTYHIGNILQ

SEQ ID NO: 5370 - protein, 499 aa, Staphylococcus epidermidis
VLFMENKNNNVDRGNLKQNLSEKFVWAIAYGSCIGWGAFILPGDWIKQSGPIASSIGIVIGALLMILIAVSYGALVEKFPVSGGAFAFSFLSFGRYVSFFSSWFLTFGYVCVVALNATAFSLLIKFLLPNVLNNGKLYTVAGWDVYITEIVIATVLLIVFMLITIRGASVSGSLQYYFCVAMVLVVALMFIGSFFSSHFSLSHLEPLASVDKGWFQSIIMIVSIAPWAYVGFDNIPQTAEEFNFSPNKTFKLIVYSLLAASLTYVVMLLYTGWLSTQATSLNGNLWLTGAVTQDAFGFIGLAVLAVAIIMGIFTGLNGFLMSSSRLLFSMGRSGIMPTVFSKLHSKHKTPYVAIIFLVAVSLIAPWLGRTALTWIVDMSSTGVSIAYFITCLSATKLFSFNKQSNTYAPVYKIFGIIGSIVSFVFLCLLLIPGSPAALSIPSYIALGIWLVIGLIFFIIRLPKLKKMNNDELSRLILNHSEDEVLEMVHEPGQSNSTNK

SEQ ID NO: 5371 - protein, 387 aa, Staphylococcus epidermidis
WRVIKMKQPVIIAAKRIAFGKYGGRLRHLEPESLLEPLFNHFTDQYPKVMSLLDDVILGNTVGNGGNLARKSLLEAGLDFKIPGITIDRQCGSGLEAVIQACRMVQSGAGTIYIAGGVESTSRAPWKIKRPQSVYESEFPQFFERAPFAREGEDPSMIEAAENVAKKYHISRNEQDDFAYRSHQLASKNMNNGNISQEILPFKVKGEYFNQDESIKPQLTLRTLGRLKPLLNEGTVTVGNSCKKNDGAVLLIVMEENRARQLGFTEGIKFVNSATVGVQPQYLGVGPVPAVNQLLAQERLTINDINAVELNEAFSSQVIASQQQLNIPLNKLNCWGGAIATGHPYGASGAALVTRLFYMKHQFRTIATMGIGGGIGNAALFERWYGN

SEQ ID NO: 5372 - protein, 414 aa, Staphylococcus epidermidis
YRILLTYVRKYRHSINIGCIPTKTLIHDGIEGSSFKEAITRKKEVVQALNNKNYQGLNSKDNIDVLNYKANFISNEVIELQDNNGTIQETITADKIVINTGSRANIPDIKGIDTAQNIYDSTGLLNIDYQPQELVIIGGGYIALEFASMFANFGTHVTILERGDAIMTNEDQDIANLIVKDLQDKGVTINTNTSTIAFSNNKDQTIIHTNHGEISADTVLLATGRKPNTNHLGLENTDVKIGKQGEVIVNTHLQSTVKHIYAAGDVKGGLQFTYISLDDYRIIKSHLFGDGSRTTENRGAIPYTVFIDPPLSRVGLIASEAKLQGYDILENKVFVSNIPRHKINNDSRGLFKAVINKDTKEILGASLYGKESEELISLIKLAIDQHIPYTVLRDNIYTHPTMTESFNDLFLEPL

SEQ ID NO: 5373 - protein, 166 aa, Staphylococcus epidermidis
MSAIIEAKKQQVDTIAEQLKNSVSTVIVDYRGLTVAEVTELRSQLREAGVEYKVYKNTMVRRAAEQAGIEGLDEFLTGPTAIATSTEDVVAPAKVIAGFAKEHEALEVKTGVMEGNVISAEEVKTVGSLPSHDGLVSMLLSVLQAPVRNFAYAVKAVGEQKEESAE

SEQ ID NO: 5374 - protein, 293 aa, Staphylococcus epidermidis
GVHMTNNHFLNIGVLLYGCGHHQAAWRMKDSNIEDIGNISYYQHLAQIAEKGLLDIVFFADNQAFNASDNTTMPAFWFDPIINLSAIAQVTSHIGLVPTISSTFSNPFTASRQLLSLDYLSHGRVGWNLVTSMTDIEAQNHSLQYLPERHERYKKADEFASVMNQLFTSWSTASYVPDKNNNKIIESKDIKPFYHEGDYFQVRGPHTTPQSPQGKPVSMQAGASKEGIALAAKYADAVYSVSWDIKQARSYKKKLSDAISKTQHPDRKIKIFPGLVTYVGETHEKSIIKKSRT

SEQ ID NO: 5375 - protein, 148 aa, Staphylococcus epidermidis
IMSIKDLNRGDRIRMQEVNGVEITVQIKNVYRLVQSSLDMDKWVADVEAIDGRTWTIDDCYDFYSLPNGNEGTKKTLDDKVNHPSHYTYGDMEIIDFIEQVTKDYKPELAFAIGNAIKYISRANRKNGKEDLDKARWYLNRAFEKWEG

SEQ ID NO: 5376 - protein, 416 aa, Staphylococcus epidermidis
MMSIDVLSTEESIISNLMRNPELLGKFRLKPEMFTDEKLRVFIEYVLEQGKVDVNQIYFKSRDDNEFISTDRLGRLYNSDGTDKAFFMDDQLNLLQEYVLSQAREKLTEYQSMPSKENFNYLVEELEKLKGMTIKKSDATDSFLAEVVENILSDEPKQFIKTGIASIDNKIIGFEPGQLNVLGARPSLGKTSLALTMMWNIAQRGYPTTFFSLETGGNNIVERLVATITNIPLSKIKQGNGLNDDEVSSVMSAIDQIKKCNSLKIEDQAQMTPQDVREVASQKADKPHVIFIDYLTLMQSDVPQRDRRLEVEKISRDLKIIAKETGCIIIALSQLSRGVESRSDKRPMMSDLREAGGIEQDANMIFFLYRDDYYDQDQQDNITGKSEIEFIISKNKDGETGVAHLDFYKKTQRFYG

SEQ ID NO: 5377 - protein, 414 aa, Staphylococcus epidermidis
ETIMRDKFEITFIKNRRDLIMAKEKFDRSKEHANIGTIGHVDHGKTTLTAAIATVLAKNGDTVAQSYDMIDNAPEEKERGITINTAHIEYQTDKRHYAHVDCPGHADYVKNMITGAAQMDGGILVVSAADGPMPQTREHILLSRNVGVPALVVFLNKVDMVDDEELLELVEMEVRDLLSEYDFPGDDVPVIAGSALKALEGDAEYEQKILDLMQAVDDYIPTPERDSDKPFMMPVEDVFSITGRGTVATGRVERGQIKVGEEVEIIGMHETSKTTVTGVEMFRKLLDYAEAGDNIGALLRGVAREDVQRGQVLAAPGSITPHTKFKAEVYVLSKDEGGRHTPFFTNYRPQFYFRTTDVTGVVNLPEGTEMVMPGDNVEMTVELIAPIAIEDGTRFSIREGGRTVGSGVVTEIFE

SEQ ID NO: 5378 - protein, 158 aa, Staphylococcus epidermidis
VKPMKKALSKKAELDQKLPIEDALKQLSFFVQQDCSDWELDEPVPPLPPAKNFKGPIGRYETVLAIIKDKQPTVRELLGYLSAGGGHLTLIGTPEEIVDEMEQWFNEGVADGFNLMPPSLPHSLEDFLKYIIPELQRRALFKNSYNQSTLRTLLNLDS

SEQ ID NO: 5379 - protein, 229 aa, Staphylococcus epidermidis
KGVFCMNYFRYKQFNKDVITVAVGYYLRYALSYRDISEILRERGVNVHHSTVYRWVQEYAPILYQIWKKKHKKAYDKWRIDETYINIKGKWNYLYRAIDAEGHTLDIWLRKQRDNHSAYVFIKRLIKQFGKSQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 5380 - protein, 178 aa, Staphylococcus epidermidis
PLIIEGWFLMLINVLNLNDSQDGNRIKQGDLSHMRYILSDNNNEDLKLEGLPAKVFLTDSTGVKYIYDTTVRQYDNAYVCDVVINQIIPANTYSLEIWVDNKYVFPSDNKAKIQVTESVIGRQLINTQNHDLWQEMIEYGVKNGLIKNQTESEENFVIGENAPNDTTKIWIDTTGGNE

SEQ ID NO: 5381 - protein, 122 aa, Staphylococcus epidermidis
VRIMNKEQILQLIEQELIQADEAQTDTEFEKHMYAIHMLTSLVSSHQSRSTIEKLNHSKPMNSNIKDDYEMKQQSSQKHHVTAAEIEAMGGKVPQSMKKHHTSNNMMITDDQVGNGESIFDF

SEQ ID NO: 5382 - protein, 236 aa, Staphylococcus epidermidis
AHVIMIFFHMCWNTSLMVQYSLSILTFGEVIMNKPFIAIEGPIGVGKSSLAHRLSKTFGFYEEKEIVDENPFLSDFYDDIEKWSFQTEMFFLCNRYKQIRDIESLNQGIVSDYHIHKNKIFAKNTLDAKEFDKFSRIFDILTEDIEMPNTIIFLDADLDVLKSRIAQRNRSFESQIEDDYLLTLKKDYLAYYESLKNDGANVIRIDTSQQDFVKNDYDYQNILNLVKPMIGENKDE

SEQ ID NO: 5383 - protein, 202 aa, Staphylococcus epidermidis
GVVIMKREFLRGLGVEEDAIQKIIDEHHEGLQSYKEKVEKVDSLKEQLETANEEIKNRDNQIEELKNNVGDNDELKQELEKYKEQNANYDQKLKDVQLNKAIEVSLAKEKAIKPEQVIKLIDKDNLEVDDNGNVKGLDDYMSEFKKENEHLFEQSKPSGRTPDDGKNVNGGITQEEFNNMSVAERTNLFVNDRKTYDTLINN

SEQ ID NO: 5384 - protein, 228 aa, Staphylococcus epidermidis
MVVIKNYITEDDGTTTVVIKGVELDNKTSLLLDNGYEVEVDVRVVDPFKITDKQRRKVFALCNDIECATGQPRDYMRYMFMDYVEVLYGYEKRLSLSNCTREQASQIIEVIIDWVFHNNIPLNYKTSDLLKNDKAFLYWSTVNRKCVICGKPGELAHHKAIGRGANRKKMDHYGYEVLALCREHHQSQHDMGVETFDKLHHLENSWLSVDERLNKMLKGVKNEFESNN

SEQ ID NO: 5385 - protein, 66 aa, Staphylococcus epidermidis
PPKIPKYKKCKNSKIESKNMVTENPIVTYSLYLIPSTKRYIINISIKTKTIDNVIIVIIYIISPNI

SEQ ID NO: 5386 - protein, 192 aa, Staphylococcus epidermidis
RCKIMKGLIIIGSAQVGSHTNALSKYLKGQLGEHDVEVEIFDLAEKPIHQLDFAGTTQAVDEIKNNVKSLQSKAMEADFLILGTPNYHGSFSGILKNALDHLNMDHFKMKPVGLICNSGGIVSSEPLSHLRVIVRSLLGIAVPTQIATHDSDYAKLEDGTLYLEDNEFQLRAKLFVDQIVSFVTNSPYEHLK

SEQ ID NO: 5387 - protein, 60 aa, Staphylococcus epidermidis
YKKITLKDGLLFKKMFIETEDFMFNYSTSKALLSDFQNNNFNYFIQNKKERVIFEDGHFL

SEQ ID NO: 5388 - protein, 225 aa, Staphylococcus epidermidis
LEKIKMNNYGIPQNAVITIAGTVGVGKSTLTQALADKLNFKTSFENVDHNPYLDKFYHNFERWSFHLQIYFLAERFKEQKRMFEYGGGFVQDRSIYEDVDIFAKMHEEQGTMSADDYHTYYELFNAMVMTPYFPKPDVLIYLECDYDEVIDRIQQRGRDMEINTDPEYWKKLFKRYENWINNFNACPVVRLNINEYDIHEDVDSLDSVIDKIAQVIKAYRQVDTR

SEQ ID NO: 5389 - protein, 901 aa, Staphylococcus epidermidis
INEIGGNVLAKLLYKLGKFIAKNKWLSVIGWLVILGVIITPLMINSPKFDSDITMNGLKSLDTNDKISKEFHQDSEKASMKIVFHSNKNDGLNNKDTKKDIEDALDNIRQNDDYIQNISNPYDSGQVNDEGDTAIANVSYVVPQTGLKDSSKHIIDKELKDVTDNHNVQIEKTQGGAMNSEPGGTSEIVGIIVAFVILLITFGSLIAAGMPIISAIIGLGSSVGIIALLTYIFDIPNFTLTLAVMIGLAVGIDYSLFILFRFKELKKKGVDTVEAIATAVGTAGSAVIFAGLTVMIAVCGLSLVGIDFLAVMGFASAISVLFAVLAALTLLPALISIFHKSIKIKDKPTKSKDPKDHSWAKFIVGKPVIAVIVSLIILILAAIPVSGMRLGIPDDSLKPTDSSEYKAYKLISDNFGEGYNGQIVMLVNTKDGGSKSTIERDLNNMRSDLEDIDNVDTVSKAQLTDNNNYALFTIIPEKGPNSQSTENLVYDLRDYHSQAQEKYDYGTEISGQSVINIDMSEKLNNAIPVFAGVIVVLAFFLLMIVFRSILVPLKAVLGFILSLMATLGFTTLVIQHGFMGSLFGIENTGPLLAFLPVITIGLLFGLAIDYELFLMTRVHEEYSKTGDNDHSIRVGIKESGPVIVAAALIMFSVFIAFVFQDDSAIKSMGIALGFGVLFDAFVVRMTLIPALTKLFGKASWYLPKWLGAVLPNVDVEGKALEEDNHHDTSSEKGHVNDKNSEYSRQDKDNYVYQNDKRNYNRNYNDEDYNRSVHLNNHHDQHHRQHQYDNQRDDIDYESLYTQDGDHTHHDERNYNDRHYQDNYDRNDDYRHNNHDHQNDNHDYHDSNFDKTTNLYKELTDSNIDQDVLFKALMLYARENNKGVYDRYNRSSQHRHDDELRD

SEQ ID NO: 5390 - protein, 169 aa, Staphylococcus epidermidis
VEEIRPITYQDKEAYYYYIQEWYENEEKVVPGNTDIANYSSFNNMVDRLNCSEVDEGFVPTTTLFYFKDSIIIGAVDIRHQLNDKLSNIGGHVGYGVAKSYRGKGYATILLEKALDELKTLNVEVVLMTCNPLNFASQTVMKKCGGYQIESYIKKNGKPVHRYHIPNTK

SEQ ID NO: 5391 - protein, 355 aa, Staphylococcus epidermidis
KLRIQLLLELLIMINQVYQLVSPRQFEATFKTIDLHNHNSKVIVRPLYLSICAADLRYYCGNRDSKILSKKLPMSLIHESVGEIVYDSEHRLKNGTKVVMIPNTPSKSHNIIAENYLTSSHFKSSGYDGFMQDYIVMKPDRVVTLPQEIDLSVASYTELVTVSVHAIDRFQSKAIPQFESLGIWGDGNLGYITAVLLKKLYPTTKIIVFGKTLYKLSRFSFVDEIIQIDNIPQHIKIDHAFECVGGKGSQQAIEQIINIINPEGSIALLGVSELPIQVNTRMVLEKGLTIIGSSRSGLKDFEKTIELYRKYPEVLNQLALLKGKEFEINTIEDLITAFEYDISNAWGKTVLKWNI

SEQ ID NO: 5392 - protein, 147 aa, Staphylococcus epidermidis
IRRIRMTNLTILTGRITKDLELKQAGQTQVTNFSMAVDNPFKKDDTSFFDIVAFGKTAQLLNDYCGKGSKVLIEGNLKQDRFQDKEGHNRSVVRVIANRIEFLDSKGSNQQNNQPQKQQEQTTETKSKNPFANASGPIDITDDMLPF

SEQ ID NO: 5393 - protein, 247 aa, Staphylococcus epidermidis
RCLILKIINLDSKNLASFYVACELFKQIQQHPHAKLGLATGGTMTDVYHYLVNLLIKNKVDVSQVETFNLDEYVGLKASHQQSYHTYMNKVLFEQYPHFVKNHIHIPDGLSENLEAEAERYNNLLDERGPIDIQILGIGENGHIGFNEPGTDFNSETHVVNLTESTIKANSRFFDNEKDVPRQAVSMGVKSILKAKRIILLAFGPKKKEAISKLLNEQVTEDVPATILHTHPNVEVYVDDEAAPDCL

SEQ ID NO: 5394 - protein, 269 aa, Staphylococcus epidermidis
LFVIEFDMNPIKILKKERIIMSEAAETLDGWYSLHLFYAVDWTTFRLIAEDDREAMITELETFIKDKTVARESHQGDHAIYNITGQKADLLLWFLRPEMKELNQIENEFNKLRIADYLIPTYSYVSVIELSNYLAGKSDEDPYENPHVKARLYPELPHSEYICFYPMDKRRNETYNWYMLPIEDRKTLMYNHGMIGRKYAGKIKQFITGSVGFDDYEWGVTLFSNDVLQFKKIVYEMRFDETTARYGEFGSFYIGHILNIEDFKQFFSI

SEQ ID NO: 5395 - protein, 193 aa, Staphylococcus epidermidis
ENQIMPSANQKRMIKHIHETVFILLHDYHFDEITVQKICDIAEINRSTFYRYFQDKYELLYTLPDFITQQIIAKSDTSADITTPESFEDFIYYIGNNKKIFKHLLVSSRQADVFRSLTNVSREMMLNNPTRKRAPLAQKIRESKHPEIVADFYSSGVIEVLRRWVENDYNYTVEEVFVTLNNVLETSLYCYDK

SEQ ID NO: 5396 - protein, 437 aa, Staphylococcus epidermidis
CGQINNKSKRLRWCISMMISIKLSELLPKHFHSLWKATKDREKLNIVAKGGRGSGKSSDISIIITQLIMRYPMNAVVVRKTDNTLATSVFEQIKWAIEEQKVSHLFKVKVSPMEITYVPRGNRIIFRGAQNPERLKSLKDSRFPFSIMWIEELAEFKTEDEVTTITNSMLRGELDDGLFYKFFFSYNPPKRKQSWVNKKYETSFQPDNTFVHHSTYLDNPFISKQFIQEAESAKERNEQRYRWEYMGEAIGSGVVPFNNLQIEKIPDELYDNFDNIRNGADFGYAADPLAFTRWHYDKKKRILYAMDEIYGVQMSNREFAKELWKRGYQSDEIYCDSAEPKSIDELKKEHGIKRVKGVKKGPDSVEYGEQWLNDLDAIVIDPNRTPNIAREFENIDYETDKDGNVKPRLEDKDNHSIDSCRYALSRDMRQNKLSILT

SEQ ID NO: 5397 - protein, 427 aa, Staphylococcus epidermidis
LEGIKVKTQVLYGKSEIEINVPDDSTIIEPQNIDAIQDYESTIKNVLRNPTNSKPLKEMVNSNDIVSIVISDITRPTPNHILVPLLIEELNHVPRENFVIINGTGTHRDQTRDELIQMLGEDIVNSVKIVHNHCSEKESLAKVGHSQYGCDVYLNKAYVESDFKIVTGFIEPHFFAGFSGGPKGIMPGIAGLETIQTFHNAKMIGDPRSTWGNLEDNPVQDMAREVNRMCKPDFLLNVALNKSKEITAAFAGEILDTHKEGCAYVKDHAMFKCEQRFDIVIASNSGYPLDQNLYQTVKGMSAASKVVKKDGHIIMVSECADGFPDHGKFAEIFKMADTPQGILELIHNPNFKEVDQWQVQKQASIQTFANVHVYSELTDQQLKDSMLIPTSNIEHTIQELEHRYGRKLTIGVMPQGPLTIPYVEDKE

SEQ ID NO: 5398 - protein, 111 aa, Staphylococcus epidermidis
LVVFILSEVGVYMTESSQRGDYERRIKRLEDNDEKIFNSLEQIKDGQHNQNLINQKMNFTLDSINRERELESQNKKENQKNIKDIKMWVLGLVGTIAGSLIVAVLRMFFGV

SEQ ID NO: 5399 - protein, 114 aa, Staphylococcus epidermidis
QMNFKQMHQFNYRLPELLTNYLHLIHSTSEPRMCHAMKKGEIHDYCISHYYIFYYSNFNNLATKRIRYRDFCSHRRAFSYRYWSSECLRYIRSDKYSLKCHTYLCRSYPYFINP

SEQ ID NO: 5400 - protein, 85 aa, Staphylococcus epidermidis
FVNVKKEGLIMRFKLKEDEILEFLDLNFPQQTFEKGRLLIGQNKRQPLHVYYFGKKFLALLNVNFNTFEYIKVDEVDYNDIKKSL

SEQ ID NO: 5401 - protein, 69 aa, Staphylococcus epidermidis
KFYVVGKCNTLEKLLVKIACIKEIYKKTGSVAKLKLYAHLYKTIKANIVLTVKSFISINYFSFFSINIT

SEQ ID NO: 5402 - protein, 484 aa, Staphylococcus epidermidis
HTYVNEVISINWPWDKPYHEQVVEQIKPKYETQEEMILRLVREHKENIDNITMGERYYNHHPDILDAPFKRDVNGDYDETKPDWRMYTNYHQNLVDQKVAYAVANPVTFGVDNDKALKQIQHTLNHKWDDKLVDILTAASNKGIEWVQPYVDEEGEFKTFRVPAEQAVPIWTNKERDELQAFIRVYELDGAERVEYWTKDDVTFYELKEGQLIPDFYRSEDHIQPHYYQGNKLMSWGRVPFIPFKNNPQEVSDLFMYKTIIDALDKRLSDTQNTFDESVELIYILKGYEGEDMKDFMHNLKYYKAISVAGESGSGVDTIKVEVPIDSVKEYTKMLRDYIIEFGQGVDFQQDKFGNSPSGIALKFMYSNLDLKANKLKNKTLTALQELLQYIIDFYRLDVKVQDIEITFNFNVMVNELENSQIAMNSTGLLSKETILSNHAWVEDPVAEMERIEQENIELNQQLPDIEEGLNGEQQRQSKNNQPE

SEQ ID NO: 5403 - protein, 362 aa, Staphylococcus epidermidis
EATVMSEKVKFEKRESLKEKPDTANLGFGQYFTDYMLSVDYDADQGWHDMKIVPYAPFEISPAAQGLHYGQAVFEGLKAYKHNGEVVLFRPDQNFKRINNSLARLEMPEVDEEALLEGLKQLIDVERDWVPEGEGQSLYIRPFVFATEGVLGVRSSHQYKLLIILSPSGAYYGGDTLKSTKIYVEDEYVRAVRGGVGFAKVAGNYAASLLAQTNANKLGYDQVLWLDGVEQKYVEEVGSMNIFFVENGKVVTPALNGSILPGITRKSIIQLAEDLGYEVEERRVSIEELFNAYDKGELTEVFGSGTAAVISPVGTLRYEDREIVINNNEPGKITQKLYDTYTGIQSGKLEDKYGWRVEVPKY

SEQ ID NO: 5404 - protein, 125 aa, Staphylococcus epidermidis
FKGVNVLEPIKEQEVLDLLTSYSNQPVYLHVETTNGAYANHFDQRVFNAGTFLRNIVVTFEHAQLKGGDKDPYRVGLKLKDGGWVYVQGLTHYEVNENNEFLIAGFNYEGQLAATIEISKQPFTI

SEQ ID NO: 5405 - protein, 314 aa, Staphylococcus epidermidis
LLMVKQVRLGKSDVNVFPIALGTNAVGGHNLYPNLDEEQGKEVVRQAIDNGITLLDTAYIYGPERSEELVGQVVKEYPREKVQIATKGSHVIKENEEVVQNNDPEYLKQQVENSLERLQVDYIDLYYIHFPDDDTPKDKAVAALKELKDEGKIKAIGVSNFSLEQLKEANKDGYVDVVQLEYNLLHRENEEVMAYAAENNITFVPYFPLASGILAGKYDENQTFEDHRAERPDFQPDVFKDNVRRVKALTDIAEAHDTTIANVVLAFYLTRPSLDVVIPGAKRAEQVVENIDAANIELSQGEIDKIDSLFPIKK

SEQ ID NO: 5406 - protein, 146 aa, Staphylococcus epidermidis
DMWVSVERYLFNKIYNKLKSNPIINKQLDGRVFDCVQKDAVYPYIVVGETNVTNKETTTSMFEDVGVTLHVYSQARNRDEASQIIQYLGFVLNSEIEINNYSFIKSRIDTQEVITDIDQYTKHGIIRLVFKYRHNTLQRSVTNGAE

SEQ ID NO: 5407 - protein, 158 aa, Staphylococcus epidermidis
RLILKRGKHVMLKRRSSKFLGLLATLALAIVLSACGNSGNGSGSSDDSQTSLGNKEIEISYIASDNSTPRSLVIAEVLKKAGYDVTTTPVTASGPLYAAVSENSDSFHASGIFPTTDKSYYDKFKSKLTIYDDKHLIDNAKVGLAVPKYVQDVDSISD

SEQ ID NO: 5408 - protein, 618 aa, Staphylococcus epidermidis
LPILLKTLQGIGQSLPVETKLNEKLNEDGSLEIEMVENKATFDAIGAITKMWTITGVGGADDLNEYRIVMLDKTTVGQKEKLTIKARPVELDDLNNLRVYEVYNGSFTGKRYFDLVFKDTGYKYELHAKVSSSKFENLGNHDTNLELFKKGLERYDLEYEYEPKTKTFHLFDVVQRKADYYIKAGVNANNVKVQEDASKCYTYIRGYGGFDDQQTFNEASLQYEYTHPLADLIGKRHAPPVVDGRMTKGDTLKKAMELVIQESLKTSVTLDFISLQKHFKEAVPRVGDIVNVVDDLIGLNEFVRIIEITTHRDIYNKIIKQDVVLGEFRLQDRYMKAVNTAANYVKAIKSNKSDPAKDLRSMQAQTQANTKTTQDLQKKTDDIKKRLESAHAKSVTTANGTIVHDFTPKSKIRKVKTIGTIGDSVAKGTGAKTNFTQMLAKKIKAKSTNLAVSGATISTNKDNSIYEQATKIKGDLIIVQGTDDDWTNDIKIGTDKTDIKTFYGAFYSAISKIKSNNPKSKIIVMTPTKQCYIKDGKVVRKDTTKNDLGYTLADYVDVQIDACNELDIPVYDAYHSTQFKPNIPSYRKSSMPDGVHPNEKGHEVIMYELVKNFYGFYG

SEQ ID NO: 5409 - protein, 574 aa, Staphylococcus epidermidis
NGIFKEKETTMTKQNIFIDDIYWERVQLFVKGHFEGVKPTRNFLLRNLTETKLLNANHVNIQGSTFEARFNIAILEKGNFLGTGNYILINRQEDEYVCQINPKFLNDKKNQMTLEELRDYNSLETQSLQKSYLLKKYGKSFQRYNNKEIKSYVIVPAISQEINEFIFKVQYKSEIKKISKLKQLSYILHKALRKISFNVRDKIYLSVFNISKTVYKNNKNHVLFTSDSRANMSGNFKFIYEEMLKQQLDKKLVIHSIFKPNIANRRSFIDKLKFPYFLGKSKYILVDDYHPMIYKLQFRENQEIVQVWHAVGAFKTVGFSRTGKKGGPFIDSIGHRNYSKAYVSSNNDILYYAEAFGIEEHRVIPTGVPRTDVLFDESYKTRIKQSLETKLPIIKNKKVILFAPTFRGNGHRTAHYPFFKINFARLASYCEEHQATVLFKMHPFVRNKLNIPAIYSKYFLDISNYREVNDVLFITDILISDYSSLIYEFSVFKKPMLFYAFDLEDYIYTRDFYEPYETFVPGKIVKTFDELILALENNDFELEKVKPFLNKNFKYKDGKSSERLVKDLFNKFFQ

SEQ ID NO: 5410 - protein, 94 aa, Staphylococcus epidermidis
FCVFLTITSPDCRLISSTCLNVLINKCLLFKVQFRHRILPPTLTVKHLYLTYKKKTLHKQCLMIMFCYLFEFMYSCHISMSHQYIKKLPVCSHG

SEQ ID NO: 5411 - protein, 128 aa, Staphylococcus epidermidis
RSTFKMMKVFIILGALNAMMAVGTGAFGAHGLEDKLSDKYMSIWEKATTYQMYHGLGLLVIGLISGTISINVNWAGWLLFFGIVFFSGSLYFLALTQVRILGAITPIGGVLFIIGWLVLVIATLKFAG

SEQ ID NO: 5412 - protein, 267 aa, Staphylococcus epidermidis
IFFSLKSFPKKNSKQIKEGLKVNELQTFNFEDLPVRTLSIDDEPYFVGKDVADILGYSRGAKAIQDHIDKEDIRVVPIQDRTGRYQKASLINESGLYTLVIDAVRQSNNRDIKKKAKAFKRWITNEVLPSIRKTGSYQVPDNPMDALKLMFDAQKQTKEEIATVKADVIDLRENQKLDTGDYNLLSRTINQRVAHIQKIHAITNQKQRSELFRDINSEVKKMTGATSRTNVRQKHFDDVISMVANWFPSQATLYRIKQLESNLEKGQ

SEQ ID NO: 5413 - protein, 87 aa, Staphylococcus epidermidis
IMKFTIEMVNEYLTIVNDENPIHRSIVPGQLICEKVFSELNVNWMNYKIKYLKPINIDEEVQFLIKENDEIVVFKTYDDTKLTITRS

SEQ ID NO: 5414 - protein, 262 aa, Staphylococcus epidermidis
SSVSYNCHVIYNTIVYVTIINIKIIFRRELKLEWILFDKDGTLIEFDSSWEKIGVRLVDQLLETFPVHDKEAAHRQLGIIDKKIKPDSVMGSGSLGEIIESFNGVTGKETSDWTKDTSQELIDSRVPENNWIDGVQETIQALRNEGYHIGIVTSDTKKGVDQFLEETQTRNLFDLVISTETHAEEKPHPKVLDPLFNAFDVKPEKVAIVGDTANDMKTAINAHLGLAIGVLTGVAKKEELYDADVIINSAKDVKQVIEQYGK

SEQ ID NO: 5415 - protein, 102 aa, Staphylococcus epidermidis
VCYSSIKIDDQTKKYRKKETMIMDFVEQAVKEIKEKIGKELDLEKETYLLQTPSAYMQIGLEEDDDDERKLNVQVTGGNITCLKTDKDIFKDLYVNDDENDN

SEQ ID NO: 5416 - protein, 511 aa, Staphylococcus epidermidis
IMELEKVGKLDLNEEPYLQPISNRGIGFYNLDKNTAKFQFVVQKDNKPLLISDKNVKGYAFFKAANGTEEKRPSTSGVLDVEFIDPMKGLIGVTVPQWFLKNVVDSEVLGEIYLSLNDVNNVGKDDTVVLGTFKFTVRDSLINQIESDIKVSYIRMFDELRSELEKKVQQLKQDIGDTQTLIESIKQTAEEYLIKINKAQADAIVSITDALISSNQSIDLEREEALRQIDAKRDAIKTDYDLASDTFQKTYDSNVDAFNSNVNQANTTIDEKLQIFNETLERDGFTTPEYVESKFTEKDWQKFKLTNDDGTNFYDANLQIDFDNNEQLMSLPIGTRYVVLTLNNPAGTNNNGWLTKYKRNGDAVLIQYQPYNSTVIYQKRFYKSWSKWERVGSDVVDTGWIDLQLVNSASPHNDLVSKGGFTSAYRTITQNGVTKKMLRINATTIKHGQTIALLPKEFVKNLMFFSISAPRNKNSGRISLNTSGTVNFDATVDPSAWTDTDYIYGQYEWTE

SEQ ID NO: 5417 - protein, 166 aa, Staphylococcus epidermidis
WLCSRILIKLFLNKNRKEEYIMNTKYLLAVGAIVTSLTLGACGNSNSESDHANHKDKQQEDSNVKTDTTKKLSGNFESKNGEKVEGKAKIENGKLMLENYKSSKGPDLYVYLTKNGDIKSGKKISTVDYNKSKQTFDLKNVDLEKYNEVTIYCEKAHVIFGGAKLK

SEQ ID NO: 5418 - protein, 262 aa, Staphylococcus epidermidis
RHTSYFNSGGEMMKERFSPKTLSDITGVSIRTLHYYHEKGLLVPQQMSANGYRYYNVQDISKLQYILFLKELDLTLKQIQTYFEGDSDFRTKILHDNFYHIVKKRDRLNDIIRTLEHHFHKDNDEIEVTTMQNFNLNEQYEKEAASKYGDTHYYQAYKDKQKCKDESEQQNHFEEINKQLNMFFDEMNQLYLNKVSILEASGKTKKLQCILKEQVPNCDNQFLEYIAQIYIEDERFVKFINKQRERGLNLYISDAIKTFIKL

SEQ ID NO: 5419 - protein, 77 aa, Staphylococcus epidermidis
GFTSIYVVSRLGNTYLNHHDSISDNYMLRPSHRDTPRKKCDWLHSIINLLLYVKHMPILYCRQNNFFIQPMTNHLKA

SEQ ID NO: 5420 - protein, 227 aa, Staphylococcus epidermidis
GVISMSQNDLNKEKALVVFSGGQDSTTCLFYAKKHFKEVELVTFNYGQRHDKEIEVAKKIAKEQNLKHHILDMSLLSQLTPNALTQHELSIEDNDDGIPNTFVPARNLLFLSFAGALAYQIHAKHIITGVCETDFSGYPDCRDSFIKSMNVTLSLSMDKDFVIHTPLMWLDKAQTWALSDKLGVLDYIRHNTLTCYNGIIGDGCGECPACHLRARGLKHYLEHKGEE

SEQ ID NO: 5421 - protein, 66 aa, Staphylococcus epidermidis
GGISMSLHFQILLWLSILFIIAGTILLVTMLKTKKEERKESYLGFTVIFLIFGFAILIYTFIFGIL

SEQ ID NO: 5422 - protein, 66 aa, Staphylococcus epidermidis
IQTSSWLNIRKVTAQRAENHQKNYKKDNFYIISIEIVFIYLSWNFMSQPLIFILMSLVIILKLEYL

SEQ ID NO: 5423 - protein, 156 aa, Staphylococcus epidermidis
GIKSFLTMKTNVIIDGDACPVVNSVIELTKGTGIFVTILRSFSHFSQQIQPEHVKIVYVDDGPDAVDYKIVELASNNDIVITQDYGLASLLIDKVHTVMHHKGNIYHSNNIQSLLNQRYLNAQIRRRGGRHKGPPPFTTEDRLKFEHAFRKIINQI

SEQ ID NO: 5424 - protein, 96 aa, Staphylococcus epidermidis
TVLSSFFSFISFWFFCSLFSCLWILSHRSLSCRSLWRLNSLLRLLRLLSLRNLLRLLCIILFFFHRFFIFFFLFVFIVFFLFLLCCFITESFVTFF

SEQ ID NO: 5425 - protein, 69 aa, Staphylococcus epidermidis
NQMSFYDFILGFINDDTPLGHLAQYIFNDACFPKEEKNNNSIRTYVLLNYNDRQLIESTNRAISLYQLI

SEQ ID NO: 5426 - protein, 90 aa, Staphylococcus epidermidis
IKSSCNFSLLIGSRALKGSSMIITGGSAANARTTPTLCRCPPDSSSGFLFLNCSGFKPTIVNNSSTRKSISLSFHFFIWGTCAMFSLIVI

SEQ ID NO: 5427 - protein, 91 aa, Staphylococcus epidermidis
FTTLSCYYSALVTVASIQTVGIILVVALLITPASTAFLISKQLYAMMVIASIISVISSIIGLNFSYIYNIPSGSNYCYLYLYDLYCNAISY

SEQ ID NO: 5428 - protein, 342 aa, Staphylococcus epidermidis
LRESLFMSYILIVTIAIVIFSLIFDFINGFHDTANAVATAVSTRALTPRRAILLAAVMNFIGALTFTGVAGTITKDIVDPFKLQHGLVVVLAAIIAAIIWNLITWLYGIPSSSSHALIGSIAGAAIASQGSFAVLHYQGFTKIIIVLIISPIIAFCVGYMMYTIVKIVFKNSNLTRTNRNFRFFQIFTAALQSFSHGTNDAQKSMGIITLALIVGNLQDGSNVEPQVWVKVACATAMGLGTAVGGWKIIKTVGGNIMKIRPANGAAADISSALTIFVASSLHFPLSTTHVVSSSILGVGASNRAKGVKWSTAQRMVVTWVITLPISAVLAAIIYFIIHLFLK

SEQ ID NO: 5429 - protein, 64 aa, Staphylococcus epidermidis
TGYPLANIAETLKTSNSVIKLKIMENIGNHKKLSPKNKAIPDPNDAPLANPNVKLSASGLFNTI

SEQ ID NO: 5430 - protein, 108 aa, Staphylococcus epidermidis
INNPTPITVVMTRPRAIIITGLIYFLKCTLETLTPSTNSSGAINVTINNSESKLNSTGMGVRYKIIPRKIWINARGTLGMKVCTKELTITSATNMSRVSNISTLSPLY

SEQ ID NO: 5431 - protein, 169 aa, Staphylococcus epidermidis
ERLLVMFIYLFHFIISFIATVLFSIIFNAPKKLLLACGFVGAVAWTIYQMTVGMDLGKVGASFLGSLILGLMSHTMSRRYKQPVIIFIVPGIIPLVPGGAAYEATRFLVSNDYTNAVNTFLEVTLISGAIAFGILVSEIVYYIYSRIKQSYGKIKGKTYKKSYNMNNRV

SEQ ID NO: 5432 - protein, 312 aa, Staphylococcus epidermidis
ERMFKTLNKNDILRGLESILPKDIIKVDEPLKRYTYTETGGEADFYLSPTKNEEVQAIVKFAHENSIPVTYLGNGSNIIIREGGIRGIVLSLLSLNHIETSDDAIIAGSGAAIIDVSNVARDHVLTGLEFACGIPGSIGGAVFMNAGAYGGEVKDCIDYALCVNEKGDLLKLTTAELELDYRNSVVQQKHLVVLEAAFTLEPGKLDEIQAKMDDLTERRESKQPLEFPSCGSVFQRPPGHFAGKLIQDSNLQGYRIGGVEVSTKHAGFMVNVDNGTATDYEALIHHVQKIVKEKFDVELNTEVRIIGDHPTD

SEQ ID NO: 5433 - protein, 85 aa, Staphylococcus epidermidis
LNPPSSALATGKTPLATPLIPLIASPRARSFDKLMATPPPILLSCFAVESMKLIEFKLSSTSNKKHETSSPRLALPAFKNVGVAG

SEQ ID NO: 5434 - protein, 89 aa, Staphylococcus epidermidis
GVTPMKLNKANIFNLIFTILFFSFNILITYNANIDYKLWLIPGLAICGFALFSSLTLVIIYSDLFSEILFFINIILALYYIYPIFYEFV

SEQ ID NO: 5435 - protein, 253 aa, Staphylococcus epidermidis
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 5436 - protein, 368 aa, Staphylococcus epidermidis
MKGPSIVVKGARAHNLKGVDIELPKNKLIVMTGLSGSGKSSLAFDTIYAEGQRRYVESLSAYARQFLGQMDKPDVDTIEGLSPAISIDQKTTSKNPRSTVATVTEIYDYIRLLYARVGKPYCPYHGIEIESQTVQQMVDRILELEERTKIQLLAPVISHRKGSHEKLIEDIGKKGYVRLRVDDEIVDVNEVPQLDKNKNHTIEVVVDRLVVKDGIETRLADSIETALELAEGNLTVDVINGEELKFSENHACPICGFSIGELEPRMFSFNSPFGACPTCDGLGQKLKVDLDLVIPDKNKTLNEGAIEPWEPTSSDFYPTLLKRVCEVYKINMDKPYKKLTDRQKNILMNGSGETEIDFTLHATKWCYS

SEQ ID NO: 5437 - protein, 90 aa, Staphylococcus epidermidis
QQVPKGKRFALPNAEVMIHQPLGGAQGQATEIEIAANHILKTREKLNRILSERTGQSIEKIQQDTDRDNFLTAAEAKEYGLIDEVMEPEK

SEQ ID NO: 5438 - protein, 856 aa, Staphylococcus epidermidis
AKQFLVKGATRAMGFLSKIVDGNKKEIKRLGKLADKVLALEEDTAILTDEEIREKTKSFQKELAEIEDVKKQNDYLDKILPEAYALVREGSKRVFNMIPYKVQVMGGIAIHKGDIAEMRTGEGKTLTATMPTYLNALAGRGVHVITVNEYLSSSQSEEMAELYNYLGLTVGLNLNSKSTEEKREAYAQDITYSTNNELGFDYLRDNMVNYAEERVMRPLHFAIIDEVDSILIDEARTPLIISGEAEKSTSLYTQANVFAKMLKAEDDYNYDEKTKAVHLTEQGADKAERMFKVDNLYDVQNVEVISHINTALRAHVTLQRDVDYMVVDGEVLIVDQFTGRTMPGRRFSEGLHQAIEAKEGVAIQNESKTMASITFQNYFRMYNKLAGMTGTAKTEEEEFRNIYNMTVTQIPTNKPVQRKDNSDLIYISQKGKFDAVVEDVVEKHKKGQPVLLGTVAVETSEYISNLLKKRGVRHDVLNAKNHEREAEIVSNAGQKGAVTIATNMAGRGTDIKLGDGVEELGGLAVIGTERHESRRIDDQLRGRSGRQGDRGDSRFYLSLQDELMVRFGSERLQKMMNRLGMDDSTPIESKMVSRAVESAQKRVEGNNFDARKRILEYDEVLRKQREIIYNERNEIIDSEESSQVVNAMLRSTLQRAINHFINEEDDNPDYMPFINYVNDVFLQEGDLQDTEIKGKDSEDIFEIVWSKIEKAYAQQQETLGDQMSEFERMILLRSIDTHWTDHIDTMDQLRQGIHLRSYAQQNPLRDYQNEGHELFDIMMQNIEEDTCKYILKSVVQFEDDVVREKSKSFGEAKHVTAEDGKEKAKPQPIVKGDQVGRNDPCPCGSGKKYKNCHGKA

SEQ ID NO: 5439 - protein, 250 aa, Staphylococcus epidermidis
NKITIVYEMRDRMTHVDIAATIAPEDKLSKTLLKDIKVNEESIDIIELRIDQWPSFNKALLNEVIKQLKIFHLKILVTYRTSVQGGKGAVNEQEYLNILGELIECPQFDMIDIEWSSAVKIEKYTHLVQRAQQKGLEVVLSHHNFQETPALDELKFIYFKMQKLNPEYLKLAVMPKCQEDVLHLLEAMSLTAKHTTCRIVGISMSSLGKVSRIAQGVFGGTLSYGCIEEPQAPGQIHVSKLKSMVSFYED

SEQ ID NO: 5440 - protein, 193 aa, Staphylococcus epidermidis
GEITMIRFEIHGDNLTITDAIRNYIEEKVGKLERYFNNVPNAVAHVRVKTYSNSTTKIEVTIPLKDVTLRAEERHDDLYAGIDLITNKLERQVRKYKTRVNRKHRDRGDQDIFVAEVQESTTNNHADDIESENDIEIIRSKQFSLKPMDSEEAVLQMNLLGHDFFIFTDRETDGTSIVYRRKDGKYGLIETTE

SEQ ID NO: 5441 - protein, 270 aa, Staphylococcus epidermidis
GGVTLKKLAFAITAASGAAAVLSHHDAEASTQHKVQSGESLWTIAQQYNTSVESIKQNNNLSNNMVFPGQVINVGGSASQNTSSNTSSSSASSHTVVAGESLNIIANKYGVSVDALMQANHLNGYLIMPNQILTIPNGGSGSGSGGTATQTSGNYTSPSFNHQNLYTEGQCTWYVFDKRSQAGKPISTYWSDAKYWASNAANDGYQVDNTPSVGAIMQSTPGPYGHVAYVERINGDGSILISEMNYANGPYNMNYRTIPASEVSSYAFIH

SEQ ID NO: 5442 - protein, 224 aa, Staphylococcus epidermidis
MNELGQTIIENYNTFAPKNMFSEWLKNLLQPLATLSLGFFVYKYTDNRHKKRLLNELDSKSEWRKTLFIIGGNSTVTLDDVYQFRTALRFNFKNNGNYIDKEKSKKEGFSYFFDNMNIIIIKYCINLIEKKQAVSNSIDLDIKDQNSIRLFCRYMLADHWEKNQNKNLKFDDPNKEEELCIFTLKEFLKLHKYYQNSKDEDSKNKFKSLFDESKELVEKKDTPS

SEQ ID NO: 5443 - protein, 183 aa, Staphylococcus epidermidis
SLATQQQKLFFKLLFFTLVHVRAKLEPSHGAILTTMMIFIHINKTDYHGEVTAPKTKAAIRDIYLPFHMMNDIEKYLKWYKENNVYKDDYVLFGTFFKAYSESTIDRWFTTALKVLDEQLPDVQTFPRIVIHELRHSHASMLVNHGASIMVIAQRLGHADSNEVYNRYGHLYPSTQKEIVKYL

SEQ ID NO: 5444 - protein, 517 aa, Staphylococcus epidermidis
RFRTIVRRCKIIMAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNTVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFKVEQVDNLFYATFTKYNDNVDAEIVFEKVDLNNTIGEVAQDNGLKQLRIAETEKYPHVTYFMSGGRNEEFEGERRRLIDSPKVATYDLKPEMSAYEVKDALLEELDKGDLDLILLNFANPDMVGHSGMLEPTIKAIEAVDECLGEVVDKIIDMGGHAIITADHGNSDQVLTDDDQPMTTHTTNPVPVIVTKEGVTLRETGRLGDLAPTLLDLLNVKQPSEMTGESLIKH

SEQ ID NO: 5445 - protein, 240 aa, Staphylococcus epidermidis
IMRTNDKVLLENINDYFSHKGMSPHLIDDIKEKYRQDIKKSEEKDQDYIEYRGKSPAQLILTIQRNLFALQLNPMIFFIINFILISYLYDKQYVPFQAITGISLFYCLVIFPITLILYVRIAKKNYLYSNKYEMRTGIIIGIIALILVIMQGFHFNWAIIPISIYGHQFVFFAGIILSLVGIFFKRIEFVGVGLLFCQKTIDAMVTDPEIAQFFSLAIWIILVVLIIFYTIRLSERTKSS

SEQ ID NO: 5446 - protein, 315 aa, Staphylococcus epidermidis
ESWFLSLFFLYLLGIFVGMLLPIQTSINSRLSQFTRSSFYASTISFAVGTICLLVLNIIIHPQVLTPEFFSKQTLNYTWVLGGLLGVIYLTGNLLLLPRLGAALTVVITVTGQIIMGVIIDTFGLLGAHQQSFTLFKGVGIIFLITGIIFMNYVRRHPVNRHKNTPIVFWLLIGFVFGFAPPIQTTINSTLAQHTHSSIFASLISFSVGTIALFILTLVFNRSLKISSTHKTLGKIKSIYFIGGILGMAFVTSNIILMPFLGAALTTIIAMMGQMIMGIIIDHFGLLGSPKNKITSRKLGGLLCIAIGIILLRLF

SEQ ID NO: 5447 - protein, 170 aa, Staphylococcus epidermidis
WEVTMNNIRLLNQNDLDSYIELMKFGHHNYEWDRYYLENVSIDRLKTILSNHTDYWNIFGAFEDDELVATCTLKQMNYVGKCHKAILENNFVKNNDEIVNRELINHIIQYAKEQNIETLMIAIASNNISAKVFFSSIGFENLAFEKNASKIGNEYFDENWLIYSTTESSD

SEQ ID NO: 5448 - protein, 60 aa, Staphylococcus epidermidis
TKLTGCLMYKNYHMTKHTLPMETSVIISTHDMSQYVNDIVKKFQVLNSDSIVAQHYSIPK

SEQ ID NO: 5449 - protein, 382 aa, Staphylococcus epidermidis
IMLTEKEQDIIKQTVPLLQDKGTEITSIFYPKMFEANPELLNMFNQTNQKKGMQSAALAQAVLAAAMNINNLGAIKPAIMPVAHKHCALQVYPEHYPIVGENLLAAIQDVTGLESDDPVIQTWAKAYGEIADVFIKLEQEIYNHMLWKGFKPFKITNITQETSDIKSFTVESEEYDLSQFEPGQYITVDVSSEKLPYRAKRHYSIIDGDENHLVFGVKRDVTTEHEGEVSTILHDEISEGDMINLSAPVGGFSIENTERPQLFIGSGVGMTPLVSMFKKAASLNVPTQMIQAVVTEDERPFAQKLDSITDNYEQAQLHLHVKDKEGYLEAKELEQYLSEQPEIYICGGTKFLHSIINSLKELNYDMNHVHFETFIPRLSVQV

SEQ ID NO: 5450 - protein, 67 aa, Staphylococcus epidermidis
IFVTNPLIKREYSIKIIPQSTSRTLLLNHYYTLIFGKVKDFLYFINCRALNNVKSYLNKALYRLIVY

SEQ ID NO: 5451 - protein, 82 aa, Staphylococcus epidermidis
SNTTAFLGFFGTSTVLEIFFLSLPLFSLPLASKLFLMVTVSLESLFFFFEVELLFELLLQAVKTKTRDNNKNKTVFFICATP

SEQ ID NO: 5452 - protein, 277 aa, Staphylococcus epidermidis
VNKTIRDIILVMIGSFIFSAGINAFVISGNLGEGGVTGIAIVLYYAFHISPGITNFVLNAILIIVGYKYLSKRSTYLTIFATVLISIFLGLTETWHVETGNVVINAVFGGTCVGLGIGIIVLAGGTTAGTVILARIVNKYLDISTPYALLFFDLIVVLISLTEIPLVKCLVTVMSLYIGTKVMEFVIEGLNTKKAMTIISSRPNEVAKAIDQQVGRGLTILNGHGYYTREEKDVLYVVISKTQVSRAKRIIKNIDENAFLVIHDVRDVYGNGFLLDE

SEQ ID NO: 5453 - protein, 266 aa, Staphylococcus epidermidis
MKKTLTVTLSSIAAFIAINTAANAQESETSQLDTYATGDVITNQSNLGIYIVKPGDSLYKIALEHNLSLEELYALNPGVEPLIFPGDEIVVSETAFEQFNNTNTFVNYETNYIPVGYNNVSTDTSNTTYDNYDSESTDTYSVSNAYDGLRSVSNSANLYTTGQCTYYAFDRRAELGKPIGSLWGNASNWAYSANQAGFNVDHTPEVGAVFQSGPGQNGAGAYGHVGVVESINSNGSVTVSEMNWNGGVNVKSYRTISNPNSYNYIH

SEQ ID NO: 5454 - protein, 281 aa, Staphylococcus epidermidis
CTMTNDVQILNNGYPMPAVGLGVYKIADEQMEEVVRTALDAGYRAFDTAYFYGNEKALGSALKHSNVERDELFITSKLWNDYQGYDQTIEYFNKSLDNLGLDYLDLFLIHWPCENDQLYIESYKALEHLYEEGKIKAIGVCNFKIHHLEKLMKETKITPQVNQIELHPYFNQQDVQDFCDEHDIKVTAWMPLMRNKGLLDDPVITDIAHRYDKTPAQIVLRWHLAHNRIIIPKSQTPKRIKENFDIFDFNLELTDVAEIDSLNKNARQGKDPDDVSIGDLK

SEQ ID NO: 5455 - protein, 319 aa, Staphylococcus epidermidis
TSMTKQRIVISSLLFIFILTTCSFSYITFSKLTSRTEDIKNIKTIKAKPKLLLSTTGIQAPLNSYIFYYTPTLGQLQKLLVKNHSKVSKNTPVLEYYNYEKDHLYEELQNTLSNERNNKTLNSKNDLHYYSFLNQLKLQMIQTKSSIKSTLFSPINGSISYINSIPSKPNEKIVQINSNERIIRANISESELNLLKINQNISVTSSDNTQFTSKIKEISNIPSKIKNGVSYYDILLSTQPNHQIGTHFKIKLASNDIKLPTSAIVQKRYVLILKNGKITKREVTYKKSLKSGYINITKGLLIDEKVVKNPTSKLINIYI

SEQ ID NO: 5456 - protein, 164 aa, Staphylococcus epidermidis
IEMTAILWILIIIAFALAFIGLIKPVIPSLLMLWIGFLIYQFGFHEGRLSWIFYVAMIIFTIMILVADFVMNKYFVNRFGGSKIGEYTALIGVIVGCFVFPPFGIIIIPFVAVFIVELVQGFNFQQAIKVSFGSVIAFLASTIAQGLIMIVMVIWFFLDVFLIN

SEQ ID NO: 5457 - protein, 524 aa, Staphylococcus epidermidis
NKETIKMAKGDQYQAHTEKYHDKKSKKSYKPVWIIISFIILITILLLPTPAGLPVMAKAALAILAFAVVMWVTEAVTYPVSATLILGLMILLLGLSPVQDLSEKLGNPKSGDIILKGSDILGTNNALSHAFSGFSTSAVALVAAALFLAVAMQETNLHKRLALLVLSIVGNKTRNIVIGAILVSIVLAFFVPSATARAGAVVPILLGMIAAFNVSKDSRLASLLIITAVQAVSIWNIGIKTAAAQNIVAINFINQNLGHDVSWGEWFLYAAPWSIIMSIALYFIMIKFMPPEHDAIEGGKELIKKELNKLGPVSHREWRLIVISVLLLFFWSTEKVLHPIDSASITLVALGIILMPKIGVITWKGVEKKIPWGTIIVFGVGISLGNVLLKTGAAQWLSDQTFGLMGLKHLPIIATIALITLFNILIHLGFASATSLASALIPVFISLTSTLNLGDHAIGFVLIQQFVISFGFLLPVSAPQNMLAYGTGTFTVKDFLKTGIPLTIVGYILVIVFSLTYWKWLGLV

SEQ ID NO: 5458 - protein, 647 aa, Staphylococcus epidermidis
QNFFENSIVDNFQYLKRKISMEAYKIEHLNKSYADKEIFNDLNLSISEHERIGLVGINGTGKSTLLKVIGGLDEDFTADITHPNQYRIRYSSQKQDLNGHMTVFEAVLSSDTPTLRIIKKYEEAVNRYALDQSDSNFNKMMEAQEEMDQKDAWDYNAEIKTILSKLGIHDTTKKIVELSGGQQKRVVLAKTLIEQPDLLLLDEPTNHLDFESIRWLINYVKQYPHTVLFVTHDRYFLNEVSTRIIELDRGKLKTYPGNYEDYIVMRAENELVEQKQQEKQKALYKQELAWMRAGAKARTTKQQARINRFNQLESDVKTQHTQDKGELNLAYSRLGKQVYELKNLSKSINNKVLFEDVTEIIQSGRRIGIVGPNGAGKTTLLNILSNEDQDYEGELKIGQTVKVAYFKQTEKTLDRDIRVIDYLREESEMAKEKDGTSISVTQLLERFLFPSATHGKKVYKLSGGEQKRLYLLRLLVHKPNVLLLDEPTNDLDTETLTILEDYIDDFGGSVITVSHDRYFLNKVVQEYWFIHDGKIEKIIGSFEDYESFKKEHERQAMLSKQTEQQNKHKHQPKKKTGLSYKEKLEYETIMTRIEMTETRLEDLEQEMINASDNYARIKELNEDKEQLEATYEADITRWSELEEIKEQ

SEQ ID NO: 5459 - protein, 170 aa, Staphylococcus epidermidis
EDIAMQHLIKKHVLNGEFELVRQLMSETDFMEFEEAYISSAHEVESMMFYTCILDMIKVEESSELHDLAFLLLVYPLSEYEGALDSAYYHADSSIKLTDGNEVKSLLQMLLLHAIPEPVISDKKAFDVAKRILKLDPSNNVARNVLKDTAKRMDNVVVDINELNNQRDAR

SEQ ID NO: 5460 - protein, 711 aa, Staphylococcus epidermidis
KYAAKVILEAATKAGAPKDCIQWIEVPSIEATKQLMNHKDIALVLATGGSGMVKSAYSTGKPALGVGPGNVPTYIEKTAHIKRAVNDIIGSKTFDNGMICASEQVMVVDKEVYTDVVKEFKLHQTYFVNKNELQQLEDAIMNEDKTAVKPDIVGKSAVDIAKLSGISVPEKTKLLVAEIDGIGKDYPLSREKLSPVLAMVTAKSTGHALQICEDILKFGGLGHTAVIHTEDSQLQQKFGLKMKACRVLVNTPSAVGGIGNMYNELIPSLTLGCGSYGRNSISHNVSAVDLLNIKTIAKRRNNMQWFKLPPKVYFEENSVMYLTEMDNVERVMIVCDPGMVNIGYTDIVEQVLRRRENQPQIKVFNEVEPNPSTHTVYKGLEMFINFQPNTIIALGGGSAMDAAKAIWMFFEHPETSFFGAKQKFLDIRKRTYKITKPKNAKFICIPTTSGTGSEVTPFAVITDSETHVKYPLADYALTPDIAIVDPQFVLSVPKDVAADTGMDVLTHAIESYVSVMASDYTRGLSLQAIKLTFDYLKSSVQENDKHSREKMHNASTMAGMAFANAFLGISHSIAHKIGGEYGIPHGRTNAILLPHVIRYNAKDPQKHALFPKYDFFRADTDYADIAKFLGLKGNTTEELVDALANAVYDLGCSVGIDMNLKSQGVTEELLHSTIDRMAELAFEDQCTTANPKEPLISELKGIIETAYDYER

SEQ ID NO: 5461 - protein, 358 aa, Staphylococcus epidermidis
SNYLKGLAMMKEKLKWIWITTLIILVVSLILAFNLKSHYNHVHDKQKSKTNVQINNKNVKLYRDISYGKGIPNSKLDIITPADMSNDTKLPVIFWMHGGGFIAGDKQYKNQLLSKVAEQGYIIVNVNYALAPQYKYPTPLVQLNQAVKFIKENKHELPIDFDQVVIGGDSAGAQLTSQYVAMQTNEDLRDEMHFEQQFKPSQIKAAVFFGGFYNMKTVKATEFPRIQLFMKSYTGTSHWETDFKNLSQMSTLNQVTHEYPPTFLSVGDADPFYSQNKEFAQGLKTENIPVDTLFYDGSHHLHHQYQFHLDKPESKENIKKVLLFLSRNTSSSGVESNESSQNQPTQNTNEVSLYPFDS

SEQ ID NO: 5462 - protein, 156 aa, Staphylococcus epidermidis
QFYAIMTFIIVRVKVSSKLNKNINIQTRQVLKQNGEKQRFEFTTKGSWQQKFADFIRYEEQIEDAKVNVTIKIEDSGVKLIRKGDINMNLHFVEGHETTTLYDVPTGKIPLTVKTLSLMHFVTHNGGKLKIHYELYQDEQKMGSYQYEINYKEISE

SEQ ID NO: 5463 - protein, 70 aa, Staphylococcus epidermidis
ISKAIEIIVLTIIVVMDRIFEIRFLFLVKTKIKAHTKGNNIGNIIKLLIIFITFQCTYFILFSYSVSSIY

SEQ ID NO: 5464 - protein, 125 aa, Staphylococcus epidermidis
TLKAKMTFYCFIPTSKYLKTYLSLIAFIPGNSLPSKYSNDAPPPVEMCVKSSSKPNEIAAAAESPPPIIVVASSNLAIDSHTPIVPLAKLLNSNTPIGPFHTTVCAPCNSLLNNSTVLGPISIAS

SEQ ID NO: 5465 - protein, 666 aa, Staphylococcus epidermidis
EAYFGMVEHVPFKLKSEFEPQGDQPQAIQKIVDGVNEGKRHQTLLGATGTGKTFTMSNVIKEVGKPTLIIAHNKTLAGQLYSEFKEFFPENRVEYFVSYYDYYQPEAYVPSTDTFIEKDASINDEIDQLRHSATSSLFERDDVIIIASVSCIYGLGNPEEYKNLVVSVRVGMEMERSELLRKLVDVQYSRNDIDFQRGTFRVRGDVVEIFPASREEMCIRVEFFGDEIDRIREVNYLTGEVIREREHFTIFPASHFVTREEKMKVAIERIEKELEERLKELRDENKLLEAQRLEQRTNYDLEMMREMGFCSGIENYSVHLTLRPLGSTPYTLLDYFGDDWLVMIDESHVTLPQIRGMYNGDRARKQVLIDHGFRLPSALDNRPLKFEEFEEKTKQLVYVSATPGPYELEHTDEMVEQIIRPTGLLDPKIDVRPTENQIDDLLSEIQDRVDKDERVLVTTLTKKMSEDLTTYMKEAGIKVNYLHSEIKTLERIEIIRDLRMGTYDAIVGINLLREGIDIPEVSLVVILDADKEGFLRSDRSLIQTIGRAARNDKGEVIMYADKITDSMQYAIDETQRRREIQIAHNKEHGITPKTINKKIHDVISATVESDETNQQQQTELPKKMTKKERQKTIENIEKEMKKAAKDLDFEKATELRDMLFELKAEG

SEQ ID NO: 5466 - protein, 459 aa, Staphylococcus epidermidis
NLMAIGVILNRVFRLNNNPLFDYIYSNKESINHCYFIIPTEEFEEEAKKKAQYYYGSIQKFMYELQRYDIEPFLMSYDKLIDFCKKQAIDKVVVAGDIMSYHHEEYDILHQRKRFKQANIQVISLRANHYFNPRKTHNKQGEPYKVFTSFYRKWRPYLMIRDEYDYHLEDISKVVVKSQHKIKEDYHSYGISERDVQNRWSEFLSQDIENYKENREYLPEVLTSQLSIYLAYGMIDIIQVFNDLLQNYDKNEQNYETFIRELIFREFYYVLMTNYPETAHVAFKEKYQQLKWSYNEENFKLWKDGNTGFPIIDAAMEELKTTGFMHNRMRMVVSQFLTKDLFIDWIWGESFFKQKLIDYDAASNVHGWQWSASTGTDAVPYFRMFNPIRQSERFDNNARYIKTYIPRLNQVDAKYLHDTHKFEQQIKGQGVEIGKDYPKQMIDHKESRQRVMSEFKALD

SEQ ID NO: 5467 - protein, 158 aa, Staphylococcus epidermidis
VIVAKKKSKSPGTLAENRKARHDYNIEDTIEAGIALRGTEIKSIRRGSANLKDSFAQVRRGEMYLNNMHIAPYEEGNRFNHDPLRTRKLLLHKKEIQKLGERTREIGYSIIPLKLYLKHGQCKVLLGVARGKKKYDKRQALKEKAVKRDIDRAVKARY

SEQ ID NO: 5468 - protein, 265 aa, Staphylococcus epidermidis
FMHFKRVVKWGLNMYQNQRIKDKINILGVSFDNTTMLEMVENIKQFISSNTDDNLFIVTANPEIVDYATEHELYRNLINQADYVVPDGTGIVKASKRLKQPLKRRVPGIELLEECLKIAHVSHQRVYLLGSKNEIVESAEKKLQSQYPNIHFAHHHGYIHLEDETVIKRITSFNPDYIFVGMGFPKQEQWIQKHKDKFKHTVMMGVGGSFEVFSGSKKRAPQIFRKLNIEWVYRVLIDWKRIGRMISIPKFMLKVAIQKYKMKSK

SEQ ID NO: 5469 - protein, 108 aa, Staphylococcus epidermidis
GFNFGGDTMIEMFTQIFIISALVIFGMALLVCLVRLIKGPTTADRVVSFDASSAVVMSIVGVMSVIFNSVSYLDSIMLIAIISFVSSVSISRFIGEGRVFNGNHKRHR

SEQ ID NO: 5470 - protein, 203 aa, Staphylococcus epidermidis
RVNFILKYRQNKHFRLNGVFKMVIYIETERLNLRDWETKDLLPFQKMNANAQVRRYFPSLLSYRRSEIDMENMDSIIQESGLGLFAVELKETGEWLGFIGVNYVSKDSHYPFKELPFYEIGWRLIPEVWGNGLATEGAEAVMKYARDKGIKELYSFTSENNLPSRKVMEKLGMTFLDNFEYPNLSKYHPLKRHVRYYKELLPS

SEQ ID NO: 5471 - protein, 256 aa, Staphylococcus epidermidis
ATLYWLRYHLKKSSLILETVITEVKISMTHLLIVDDEKDIVDICQTYFEYEGYQVTTTTCGKEALKLLSSDIDIMILDIMMPEVSGYDIVKKMKDMQLDIPFIYLTAKTQEHDTIYALTLGADDYIKKPFSPRELVLRTNNLLARMSKSNHSNKIEQLEFDGLVLKNLSKTLTINNIEIPMRIKEFELLWYLASREGEVISKSELLEKVWGYDYYEDANTVNVHIHRIREKLEKHDFLPYTITTVWGLGYKFERSR

SEQ ID NO: 5472 - protein, 68 aa, Staphylococcus epidermidis
KEVYMLYVIIGFFIIGIGLYIFSFFLAQNQGLSYKSHCRNFSAVFISLGVLCLMGYLVHYVSKHYLGI

SEQ ID NO: 5473 - protein, 60 aa, Staphylococcus epidermidis
LLYYSKKVKSNGLSGAISGGAEQLFGKQKQRGVDLFLHRLTIILAILFFVLMFCISYLGM

SEQ ID NO: 5474 - protein, 60 aa, Staphylococcus epidermidis
KTHYIELYFITIYLINIKKSNEICLINSDISTFFNKCSEQYIILTMLQDNNKAHKVKYFC

SEQ ID NO: 5475 - protein, 115 aa, Staphylococcus epidermidis
IMNLILLLVIGFLVFIGTYMILSINLIRIVIGISIYTHAGNLIIMSMGKYGPHMSEPLIQGHAQNFVDPLLQAIVLTAIVIGFGMTAFLLVLIYRTYRVTKEDEISALKGDEDDE

SEQ ID NO: 5476 - protein, 82 aa, Staphylococcus epidermidis
WICYKYLVQKHVEVFYMNNGTVKWFNAEKGFGFIERENGGDVFVHFSAIVEDGYKSLEEGQSVEFDIVEGERGEQAANVVKM

SEQ ID NO: 5477 - protein, 144 aa, Staphylococcus epidermidis
HYCYKRSCFKWFFGHCSLAIDHDTVLQIEGPGDKPMTEDFESYRDRYGKGKNEWIKVYRCSHPNAGTKAAQWAKKHYENSDSEYLVTFNLKSETFTYCTKIIYQAYKYGVDKNSVSDHGLYIISPYALTDNFTDEYKLKLVKTY

SEQ ID NO: 5478 - protein, 72 aa, Staphylococcus epidermidis
VMLYSLHIKHLVKLVYWYLLNYTKGPYFLKYFNIKLHISTKYFGETLERTGQAEDYRLKLSDKKASQQYEVL

SEQ ID NO: 5479 - protein, 69 aa, Staphylococcus epidermidis
DYQYVILCILLMMNNDEQQKNESVCFTYYISVQTPKVLLILQKLLYHVKNRVKMTFLQNLYKKPRPSTH

SEQ ID NO: 5480 - protein, 185 aa, Staphylococcus epidermidis
TEGYKMKLKLLGTLALSSIILTACGQENVKKTESNPKEEQNKTDNMQTNGSVTNSNSNQKQKTAQKQISAQEAEQIVSNYYINKGINKQQVLEFKTNIDRSNANEYYVEHLVRDAAGTPIKFCAVVNKSTGEVINRFNDMNEEEMKEFEEFKKRSPKYHNSGEEKNKMQENSSSSEQQEVHNSVI

SEQ ID NO: 5481 - protein, 72 aa, Staphylococcus epidermidis
VFKYSFKEGNIMKMNPRYVKVFFLYLVSTFISNRLTTNKSLCKTLMQGILGYGLFALGLKYLTIKKKQHQAQ

SEQ ID NO: 5482 - protein, 722 aa, Staphylococcus epidermidis
SLKYKGQIKTLLNLRIRWAISMKTMEEKKYNHIELNNEVTKRKDNGFFDLEKDQEALKVYLEEIHDKMISFDDEIERLHYLVDNNFYFNVFEKYSEAELIEITEYAKSIHFQFASYMSASKFYKDYALKTNDKTKFLEDYNQHVAIVALYLANGNVKQAKQFISAMVEQRYQPATPTFLNAGRARRGELVSCFLLEVDDSLNSINFIDSTAKQLSKIGGGVAINLSKLRARGEAIKGIKGVAKGVLPVAKALEGGFSYADQLGQRPGAGAVYLNIFHYDVEEFLDTKKVNADEDLRLSTISTGLIVPSKFFDLAKEGKDFYMFAPHTVKQEYGVTLDDIDLEKYYDDMVANPNIDKKKKDAREMLNMIAQTQLQSGYPYLMFKDNANKVHANSNIGQIKVSNLCTEIFQLQETSVINDYGIEDEIKRDISCNLGSLNIVNVMESGKFRDSVFTGMDALTVVSDEANIQNAPGVKKANSELHSVGLGVMNLHGYLAKNKIGYESEEAKDFANIFFMIMNYYSIERSMEIAKERGEKYQDFEQSDYANGKYFEFYTSQEFEPKFEKVRQLFDGIDIPTSNDWKELQNKVEQYGLYHAYRLAIAPTQSISYVQNATSSVMPIVDQIERRTYGNAETFYPMPFLSPETMWYYKSAFNTDQMKLIDLVATIQTHVDQGISTILYVNSEISTRELSRLYVYAHHKGLKSLYYTRNKLLSVEECTSCAI

SEQ ID NO: 5483 - protein, 215 aa, Staphylococcus epidermidis
MLDFINHLLSYQFLNRALITSILVGIVCGTMGSIIVLRGLSLMGDAMSHAVLPGVALSFLFNIPMFIGALVTGMLASLFIGFITSNSKTKPDAAIGISFTAFLASGVIIISLINSTTDLYHILFGNLLAITHQSFWTTIVITVLVILLIIIFYRPLMISTFDATFSRMSGLNTTLIHYFVMLLLRTCNCCEHTNSWNYPCSCFTNHSSFYSFFNQ

SEQ ID NO: 5484 - protein, 343 aa, Staphylococcus epidermidis
IIDLHWFKTLYFIHKYDRRILMKAVNWNTQEDMTNMFWRQNISQMWVETEFKVSKDIASWKTLTDSEKNTFKKALAGLTGLDTHQADDGMPLIMLHTTDLRKKAVYSFMAMMEQIHAKSYSHIFTTLLPSSETNYLLDTWVIEEPHLKYKSDKIVENYHKLWGKEASIYDQYIARVSSVFLETFLFYSGFYYPLYLAGQGKMTTSGEIIRKILLDESIHGVFTGLDAQSLRNELSESEKQKADQEMYKLLNELYDNEVSYTHLLYDDIGLAEDVLNYVRYNGNKALSNLGFEPYFEEREFNPIIENALDTSTKNHDFFSVKGDGYTLALNVEPLRDEDFVFDN

SEQ ID NO: 5485 - protein, 61 aa, Staphylococcus epidermidis
KWNLFGNRENFKGTDIDKFLEINGAAILYSYSRAHISHITNTSKYPSFDLPFYNFTDNDYQ

SEQ ID NO: 5486 - protein, 226 aa, Staphylococcus epidermidis
QLIQYPKMKFRNFTIKLKFWSGYNMHLFETMKLDKGFIPRLDYHYQRISTSSEHLGFQFDHLFWKQFIHNIKTLHSKGVFRLKVTLNKEGELNYELFPIPDKPFFTARLVQQKKNIDKVIITNKTTERDYLTHNHFTDLILIYDEDGKILEFDIGNVMIQERDKLYTPTYKGDMLPGCMRQSLIDQGKVIEKDFYIEEFKEKIKSSQINVYLINSLREVVGVKVYV

SEQ ID NO: 5487 - protein, 378 aa, Staphylococcus epidermidis
QIVQRKGCHLMKIRVIVPCYNEGEVVLKTYDKLTEIMKKDSLIKNYEYDLLFINDGSTDTTIHHIKNIVAYDNHVKYLSFSRNFGKEAAMIAGYQHSTMHDAVIMIDGDLQHPPEYIPQMIEGYIEGYDQVVAKRNRQGENFVRKTLSRCYYKLINAFVEDIQFEDGVGDFRLLSRRAVQALTTLDEYNRFSKGLFEWIGYETKVFKYENVTREDGESKWTFRKLLNYGIDGLISFNNKPLRMMIYLGMFTFSISILYIIYLLINILINGINIPGYFTTIAAILLLGGIQLMSIGVVGEYIGRIYYEVKHRPKYIVENSNIQTENLDMRYNALNLNKNRNNKRSNDLYKLSSFYKVKTYSDTYASNYSQDEGFKERVH

SEQ ID NO: 5488 - protein, 86 aa, Staphylococcus epidermidis
AVLHLTPFARFEAPTPRIDEDTTCVVDNGKCNDDATKIVNAEEISAAAPLAGLIFIIFPPTVLMIFQPPTAVPNPIAVAHATLTHT

SEQ ID NO: 5489 - protein, 375 aa, Staphylococcus epidermidis
QILHSVRYNLFNEGELMYTLLLIAFTMIVSLIITPIIIVISKKLDLVDRPNFRKVHTKPISVMGGTVILFSFLIGIWLGHPIEREVKPLILGAITMYMVGLIDDIYDLRPYLKLAGQIVAALIVTFYGITIDFISLPIGPTIHFGIFSIPITVIWIVAITNAINLIDGLDGLASGVSALALMTIGFIAILQANIFIIMICCVLLGSLLGFLFYNFHPAKIFLGDSGALMIGFIIGFLSLLGFKNITFIALFFPIVILAVPFIDTLFAMIRRMKKGQHIMQADKSHLHHKLLALGYTHRQTVLLIYSIAIMFSLSSVILYLSQPLGALMMFILIVFTIELIVEFTGLIDDNYRPILNLITKKGNGKQHHYDEHHRS

SEQ ID NO: 5490 - protein, 68 aa, Staphylococcus epidermidis
WITHKIPVLKIEVRFLSRGLLNDEEILMSELICNLSLKISFFIIQFVHHFLFYPLIHSTFLNGDSYLI

SEQ ID NO: 5491 - protein, 283 aa, Staphylococcus epidermidis
GVTHMNITLGYIDPVAFSLGPIQVRWYGIIIACGILLGYFIAQAALKQVGLHKDTLIDIIFYSAIVGFIVARIYFVTFQWPYYMNHLSEIPKIWHGGIAIHGGLIGGLISGIIVCKIKNLHPFQIGDIVAPSIILAQGIGRWGNFMNHEAHGGPVSRAFLEHLHLPDFIIRNMYIEGQYYHPTFLYESIWDVIGFVILITLRKRLKLGETFFGYLIWYSVGRFFVEAMRTDSLMLTSHIRVAQLVSVVLIMISVIFVIYRRVKYQPIKYENSGPLTWPIKKAK

SEQ ID NO: 5492 - protein, 351 aa, Staphylococcus epidermidis
GVAHMKKTVLFLLLSLVLVLTACSNSSNNNSTSKKKNSDSKETVTIKNSFEASGKENNGSDKKKISNTVEVPKNPKNAVVLDYGALDVLKELGVADKVKGLPKGENNQSLPKFLDEFKDDKYINTGNLKEVNFDKVASAKPDVIFISGRTANQKNLDEFKKAAPKAKVVYVGTSDDNLIKDMKKNTENLGKIYDKEDKAKKINKDLDRKISDMKDKTKDFNKKVMYLLVNEGELSTFGPGGRFGGLVFDTLGFKPADKKVSKSPHGQNINNEYINKQNPDVILAMDRGSVVGGKATTNQVLKNKVIKNVKAVKSNHIYELDPKLWYFSSGSSTTTIKQIDELNEVVEKVEK

SEQ ID NO: 5493 - protein, 241 aa, Staphylococcus epidermidis
VGQHLRLLGKIGQCSMRDITIMRRFVGGEIMLSIEKLYQILYQNMGPQYWWPAETPIEMMLGAILVQNTNWNNADIALSRLKEETSFNAQTILKMPLESLQQVIRSSGFYKNKAKAIQALLLWLNQHHFDYSSIAKLYGDSLRKELLTIRGIGEETADVLIVYIFKGKEFIPDSYTRRIFRKLGYQHTESYHKLKQELTLPESFSNQDANEFHALLDNFGKNYFNGKGKQRYTFLDTYFKK

SEQ ID NO: 5494 - protein, 226 aa, Staphylococcus epidermidis
FVMQILLVEDDNTLFQELKKELEQWDFNVVGVEDFSHVMETFETFNPEIVILDVQLPKYDGFYWCRKMRQQSNVPILFLSSRDNPMDQVMSMELGADDYMQKPFYTNVLIAKLQAIYRRVYEFGVEEKRTLSWQDATVDLSKDSIQKDDKTIFLSKTEMIILEMLINKRNQIVTRDTLITALWDDEAFVSDNTLTVNVNRLRKKLSEIDMDSAIETKVGKGYLAHE

SEQ ID NO: 5495 - protein, 228 aa, Staphylococcus epidermidis; identical to SEQ ID NO: 4694

SEQ ID NO: 5496 - protein, 176 aa, Staphylococcus epidermidis
QNFKIYVEKNFNSGYFLSGGDNMKYKIEKLDDSSVVYMRMIGTYQSDKNFEMMKTFKHWIQTNHYWKYVEKYGVLGIALDNPLHVQSNQCRYDVVLRIDETVNDQTISKRDFTGGIYAVFKVSHTKINIEKFFSNLENILNESHLRMRNEPIIERYIEEEGTDKVCEMLVPIYEVN

SEQ ID NO: 5497 - protein, 87 aa, Staphylococcus epidermidis
EAFKMTEVDVDVAIIGAGPAGMTAAVYASRANLKTVMIERGMPGGQMANTEEVENFPGFEMITGPDLSTKMFEHAKKFGGGIPIWRY

SEQ ID NO: 5498 - protein, 163 aa, Staphylococcus epidermidis
CRFKIMMTANDWIDRLELISHPEGGYFKETMRGDGKGRASFSSIYFLLTQRDISHFHRIDADEVWYYHAGQTLKIHMITPKGEYHTVKLGRDIDCGECLQYCVPKGTIFASTLDSAEGYSLVGCMCQPGFEYEHFELLTQEYLIRQYPQYESIIKRLAISQED

SEQ ID NO: 5499 - protein, 62 aa, Staphylococcus epidermidis
LKLLFDSISKLSINETVGDGAEINDVVNKRDEYKESIRYYNNHLVLVKYNEKSICKLKYLRN

SEQ ID NO: 5500 - protein, 431 aa, Staphylococcus epidermidis
SKIKYYGRLISPTHQLEDESVSQVSKGVIKDSERWYCIQCGNTSLQYFVTYNSTILDKTITYCRRCIQLGRMDSITDICLVKSFQKATKANYQLPFELSKQQQYASETIVQAIKNNNDLLLYAVTGAGKTEMMFEGIRIARQMGHNIAIVSPRVDVIIEISHRIKDAFIDEHIDVLHQSSRQQYNGHFVIATIHQLLRFKQHFDTVFLDEVDAFPLSMDPQLSNAIQLASKSNHSHIFMTATPPRHFLKQFPPEKIIKLPARFHRSPLPIPKFKYFKLKSTRKQNLLLNIFRYQINQQRFTLVFINNIEIMNKMYQQYKMDIPDLICVHSEDDLRFEKIEALRRGQHKIVFTTTILERGFTMTHLDVVVVDAGSFQQEALIQIAGRVGRKQQSPSGLVLFLHEGVTLSMILAKRNIISMNRLAIKRGWIDA

SEQ ID NO: 5501 - protein, 150 aa, Staphylococcus epidermidis
IKVNLTNKGGLTMELYSMPMFNKFLVNDIEKSSEWYQENLGFKSIFKFKNEQNQILMEHLRLAKYQDLMLISGKQFEVGNAVYTNILVPNIRILKQRISSQYIVEDLEGKPWNSIEMTIKDLDNHLITLTQSNIKNEEFNALMQHTSKTF

SEQ ID NO: 5502 - protein, 366 aa, Staphylococcus epidermidis
LMVNKGVGMEMFEAIIYNISVMVAGIYLFHRLQYSENKRMIFSKEYVTVLMTFVSLLLAAYPIPFQNEYLVHLTFVPLLFLGRYTNMIYTLTAAFIVSLVDVFIFGNSIIYGITLIVIAGIVSAVGPFLKQNDIISLLILNLISIIILLFLALLSPIYELVEILVLIPISFIITIASAITFVDIWHFFSLVNRYENEDKYDYLTGLGNVKEFDRHLNEVSSKAEEKKQSLALLLIDIDGFKDVNDHYSHQSGDAVLKQMSQLLKNYVPNQFKIFRNGGEEFSVVIRDYTLDQSVKLAENIRSGVEKSSFHLPNKEVIKLSVSIGVGYLTQEDRKSQRKVFKDADDMVHVAKSEGRNKVMFNPIVKL

SEQ ID NO: 5503 - protein, 413 aa, Staphylococcus epidermidis
LQSKNRIEVEKMFTALLQIKNYKLFVVNMLLLGMGIAVTVPYLILFATKDLGMTTTQYGLLLALAAISQFIVNSIIARFSDTHHLNRKILIITALFMGAVSFSIYFYVHQIWLFIVLYALFQGLFAPAMPQLYASARESINASSSRDRAKFANTVLRSMFSLGFLFGPFIGAQLIELKGYSGLFGGTIAIILFTLILQVFFYKNLPVKNQISEQQHIEKIAPNMFKDKSLFIPFIAFILLHIGQWMYTMNMPLFVTDYLNEKERYVGYLASLCAGLEVPFMVILGILSAKLPTRTLLIIGSVFGGAFYFSIGVFKNFHMMLVGQICLAIFLAILLGLGISYFQDILPDFPGYASTLFANAMVIGQLGGNLLGGVMSHWVGLENVFFVSASSIFVGMILILFTKDQKITIEDVE

SEQ ID NO: 5504 - protein, 397 aa, Staphylococcus epidermidis
IMAKKIVSDLDLKGKVVLERADFNVPIKDGEITNDNRIVQALPTIEYIIEQGGKLVLFSHLGKVKEESDKEGLSLKPVAENLSKKLGKEVIFVPETRGEKLETAIENLNEGDVLLVENTRFEDLDGKKESKNDPELGKYWASLGDVFVNDAFGTAHREHASNVGISTHLETAAGYLMEKEIKFIGGVVNDPQKPVVAILGGAKVSDKINVIKNLVNIADKILIGGGMAYTFIKAQGKEIGLSLLEEDKIDFAKDLLENNGDQIVLPVDCKIAKEFSNDAKITEVSINEIPSDQEAMDIGPKTVELFNKELQGAHTVVWNGPMGVFEFSNFAKGTIGVCESIAKLEDATTIIGGGDSAAAAISLGFEDDFTHISTGGGASLEYLEGKELPGIKAINDK

SEQ ID NO: 5505 - protein, 175 aa, Staphylococcus epidermidis
EEHKETCRMKHQKNQSRFKLLIAGIIAGLLSGVVKLGWEVMFPPRTPSRDATNPPQQLLQLLGIPSNITHLTYNFSEHALPWISFIVHYSFSIAIAIIYIYIAKKYTKITLGYGALFGIVIWIVFHLILMPIMHVVPNAFDQPFSEHLSEFFGHIVWMMVIEMVRRYFYNIQLNK

SEQ ID NO: 5506 - protein, 280 aa, Staphylococcus epidermidis
YGHKRLRERGKDMANSCLHILSKKEYTATRCQDGILLFWPIEGSMHFQQFMKERILSDELYIVNNMDVFSISDNGITLEVYISSDWFTELGYSFFNYHYISDLIQSKKEIKELVAQLTLNFLDNDVDKEQDIINKIVHILANEAIIDKKIAEDQYMYDYYGELKDELNYIYNHIEERLTLKDISNKLYVSKSNLSTQFHLLLGMGFKKYIDTLKISKSIEMLLTTTKTISQISETLGFSNVSTYSRQFKNYLSVTPNAYRAMKKYDKYNGCSDDDVSEHF

SEQ ID NO: 5507 - protein, 75 aa, Staphylococcus epidermidis
VSNKHNHLLFNNFVVYIIDLLFSSFLLYGLSFPIIQKLQIPIREGAFMNHNFICTRTTNFPFKKEVALYNILHDV

SEQ ID NO: 5508 - protein, 347 aa, Staphylococcus epidermidis
LMNNFRWFWFFIKSRINWILWILFLNIILLGVAYIDYEISVESVFYIVILNVGLSILFLLFTFVKEVRLSKHFYEDKEIEEIKHKDLAETPFQQQVIDYLYRHIAAQKEKVVEQQLQIKNHEQTITEFVHDIKTPVTAMKLLIDQENDDQRKRALLFEWSRINEMLDKQLYLTRLETHHRDMYFDYISLKRMVIDEIQVTRHISQAKGIGFELDFKDEQKVYTDVKWCRMMIRQVLSNSLKYSDNSTINLSGYNIEGHVVLKIKDYGRGISKRDLPRIFDRGFTSTTDRNDTASSGMGLYLVQSVKEQLGIEVKVDSIVGKGTTFYFIFPQQNEIIERMSKVTRLSF

SEQ ID NO: 5509 - protein, 318 aa, Staphylococcus epidermidis
NICNSKGYIKMKNNKNEKLKITIVSGFLGSGKTTFLTHYINELLKIDEKITVIMNEFGSFDVDGNHLSELVKVYPLLNGCVCCDMKSDLVQQIEMLSHNHETDHIIIEATGIAHPIELIMACQDPRIVQFVERPHVVSIVDALRFLQRQQYTDSTKRLMEEQLEVSDVLVVNKLDLISVEDRDALKNQLNEVNKYSSKIYTTYGQVNIEELSQFRDQLVMTHTHSHHHGINSMQYTFTTAIDRQLFYQFILRMPDNVLRLKGYVQFKDEPNVTYEFQYSFGMPDYEVINGDYPLTIVLIGEQLDVNRLKNKLDVLQFS

SEQ ID NO: 5510 - protein, 212 aa, Staphylococcus epidermidis
FSSKKKKTVPIKINNPVVVNTSLECKDNFLKLLAFHKSTTTKCPKPPKMISIGIVIMITGSFEKSIKLFLKRANPALLNAETEVNKLKNRPLPMPNFGINDKHRQSVPNNSVAMLYMARCLISLITPPGSSIFQVIINKILLLIDIFLFKKMRVSIATVTIPNPPICISNKIMISPKILNCVPTSTGDRPVTVNALEATNNASIKLMGFFPV

SEQ ID NO: 5511 - protein, 353 aa, Staphylococcus epidermidis
LPLKYLCYKDIRRKVVVKDLIKVQQKLIPDLIDKMYRRFYILSTISQNQPVGRRSLSEHMDMTERVLRSETDMLKKQELIRVKPTGMEITNEGTEVLAQLGEYFNVYSDDHKLASAIKDKFHIKDVHVIPGDSDSNRTVKREMGQQAGQLLEGILYEDAIVSVTGGSTMACVSESIHLLPFNVFFVPARGGLGENVVYQANTIASSMAQQAGGYYTTLYVPDNVSESTYDTLMLEPSVMHTLDKIKQANITIHGIGDALKMAHRRQSSQNVIDNLQHHQAVGEAFGYYFDAQGQIVHKVKTIGLQLEDLENKDFIFAVAGGQSKGEAIKAYLSIAPENTVLITDEAAAKVILQ

SEQ ID NO: 5512 - protein, 253 aa, Staphylococcus epidermidis
SQVLTYLLKCLNMLKNLVAEYQYGDIKSVEDKGDYKVINLGNKEITAHAVIISTGAEYKKIGVPGEQELGGRGVSYCAVCDGAFFKNKRLFVIGGGDSAVEEGTFLTKFADKVTIVHRRDELRAQNILQERAFKNDKVDFIWSHTLKTINEKDGKVGSVTLESTKDGAEQTYDADGVFIYIGMKPLTAPFKNLGITNDAGYIVTQDDMSTKVRGIFAAGDVRDKGLRQIVTATGDGSIAAQSAADYITELKDN

SEQ ID NO: 5513 - protein, 348 aa, Staphylococcus epidermidis
YFLNIILKEAIIMAIKVAINGFGRIGRLAFRRIQDVEGLEVVAVNDLTDDDMLAHLLKYDTMQGRFTGEVEVIEGGFRVNGKEIKSFDEPDAGKLPWGDLDIDVVLECTGFYTDKEKAQAHIDAGAKKVLISAPAKGDVKTIVFNTNHDTLDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDNEMSYTAQLVRTLAHLAELSK

SEQ ID NO: 5514 - protein, 85 aa, Staphylococcus epidermidis
LWLKSTSKVMNMKDWTINNHSKRQLIIQSNHDDISIIEPLRNGSFKILAEFNALNTDYIQVYDHTLVVSIHEKEISVLDRSSQSI

SEQ ID NO: 5515 - protein, 168 aa, Staphylococcus epidermidis
DRINLKRNVGKEMKLKNLFLSSVAVILSICLVLLLFLATNQNALAKVHKTICTFTKVKTVSHNDIFPNLNMNHVAEASEKNSDHQKNVNKTNQQSVRTQASYDFNPQECKVIALNYAENHLSKKYNIERTFNESLHSVYVFSSENKLHQTKVKVNKSGTVHASNINNH

SEQ ID NO: 5516 - protein, 86 aa, Staphylococcus epidermidis
FIVKGCDVVMNKNLLKKYLNDDSFKSVVVVIGNKRIVLENDIHVDYENEVIIYPCKNCTRIIPFSSISYLELIDKQDQFINYFKEG

SEQ ID NO: 5517 - protein, 74 aa, Staphylococcus epidermidis
FLSKLLGKLAYHHRLLTTVLPLISTNNHSCHTSTKLSFYEDKLNVDYHIFFNLHLLLYRLFITIVIIVSNKTHV

SEQ ID NO: 5518 - protein, 147 aa, Staphylococcus epidermidis
VTTKESIMRKWLTLLLITTLVLTACGKSNEKASLEKSIDQLKKENKDLKKQKKKLQEQKDKLKHKQDSLQEDVNDLPAKSTSRDKKNKDNHDAKEKSSDNQSTSANHDDQTNKIKSNQDEHDSQSSKPHTQQKPSQNDRKNNHRQER

SEQ ID NO: 5519 - protein, 252 aa, Staphylococcus epidermidis
KYQKYLKILNKVVPLNDDETFKLGIVLSYLKQYRASQNLLYPLYKKGKFVSIQMYNALSFNFYYLGNKDESIEMWNKLTQISEVDVGYAPWVIEESKTVFESRVLPLLLDDNNHYRLYGIFLLHQLNGKEILMTEDIWSILESMNDYEKLYLTYLVQGLTLNKLDFIHRGMQRLYNFKKFKYNTSLFTDWINQAEMIIAENVDLVDVDRYVAAFVYLSYRRSSQPLTKRQLMDDFNVSRYKLNKAIEFILSI

SEQ ID NO: 5520 - protein, 226 aa, Staphylococcus epidermidis
MAQKENNIIPMIFDEAFYRKMATQKWRQQDYKKAAEYYEKVLELSPKDFDIQQHYAQCLVKLNIGKKAERLFYENIVKDFHVAESFYELSQLNIELNEPNKAFLFGINYVILSEDKDFREMLEKTFEVTYTNEQKIELEAQLFSTQLLFQFLFSQGRLEEARTYILNQSYEIQQHRVIRNLLAMCYLYLGEYDSAKAMFEELLKEDNSDVHALCHYTLLLYNKKEA

SEQ ID NO: 5521 - protein, 129 aa, Staphylococcus epidermidis
MIKKTYQKGVKIIVDMRDRIIIIVPVVIGLLILRNSERRSTSSILKVPTKSKIAPIINIVGDKYGMDMYTDCVLDLSVINCNKLITMASIIAINFWSEITKGYSLKFKYICKSVHIINSVTVNIVIKLN

SEQ ID NO: 5522 - protein, 80 aa, Staphylococcus epidermidis
NHKKTFDFSPFFKVLKTLESPTYILSPINHTRLLEFLCAKNSFLHYIHKLFLLIMIIFIYFCSCDEITVVRGLKITITLN

SEQ ID NO: 5523 - protein, 398 aa, Staphylococcus epidermidis
FKEKKGSIMSEYVLTNGIVYTENEMINNGYVHIKDGKILDVGKCPFHPSSSHNTIDIIDVKKRHILPGFIDIHIHGGYGEDAMDASEQGLQHLAESLLSEGTTSFLATTMTQSTVNIERALQTIAKYTQQQDVTNAAEIVGVHLEGPFISEHKVGAQHPQFVQRPTVDKIKSFQEVANGLIKIITYAPEVDGATETLKTMKNDIIFSIGHTVATFDQANTAVSHGAKHITHLYNAATGFQHREPGVFGAAWLNQGLHTEMIVDGVHSHPASIALAYRLKGNQSCYLITDAMRAKGMPEGHYDLGGQDVIVKGSEARLSSGALAGSILKMNEGLKNLIQFTGDTIEHLWRVTSLNQAITLGIDDIKGSIKIGKDADIVIIDDACNVETTIKNGKYHAFK

SEQ ID NO: 5524 - protein, 185 aa, Staphylococcus epidermidis
RERNTLELQEAISNRRSVKKFKHDMVVDDQTVYDAIYKATDAPNHGMREPWRLVHISKDKLGDFSRDITRFAFPDSPDKREDHFHAVTNLGGMLLLILKDDPRQRQSRENYFAFGAFAQNLMLLLYEAGIGTCWKSPQYIFDPKIRKALGVKDNEILAGFLYLTDLEEVPTKAKRKNKNLITEFE

SEQ ID NO: 5525 - protein, 324 aa, Staphylococcus epidermidis
KVGKIMQMSANKKISILVVMAICMAIFYLLVGLDFDIFEYQFQSRFKKFILILLVGASIGTSVVIFQSITTNRLLTPSIMGLDSVYLFVKVLPIFILGEQATVVTNIYLNFLITLIAMVFFSLLLFQVIFKLGHFSVYFILLVGVILGTFFRSITSFLQLIMNPESFLAVQNVMFASFEASNSKLVTVSGILLVILIIVTIILRPYLDVLLLGRAQAINLGVSYENMTRMFLILVALLVSISTALIGPVTFLGLLTVNLAHEFMKTYEHKFILPATILFSWISLFIAQWVVENLFEATTEFSLIVDLVGGSYFIYLLVKRRNAN

SEQ ID NO: 5526 - protein, 199 aa, Staphylococcus epidermidis
TEGKNFAILNTYITNRECKSMTRQRIAIDMDEVLADTLGAVVKAVNERADLNIKMESLNGKKLKHMIPEHEGLVMDILKEPGFFRNLDVMPHAQEVVKQLNEHYDIYIATAAMDVPTSFHDKYEWLLEYFPFLDPQHFVFCGRKNIILADYLIDDNPKQLEIFEGKSIMFTASHNVNEHRFERVSGWRDVKNYFNSIEK

SEQ ID NO: 5527 - protein, 171 aa, Staphylococcus epidermidis
VLMKKLITSLLVLGLVLTGVSVGNNVEAATGNSMKTVQQLNKGDKSLENVKIGESMKSVLKKYSHPIYSYNPNSNEKYYEFRTDKGVLLVTANGKKERGNVTRVSMTYNDANGPSYKAVKQQLGHKAISRVHYNNVTGNFGYIQKDQASYQFSSNSPKDKNVKLYRIDLNK

SEQ ID NO: 5528 - protein, 414 aa, Staphylococcus epidermidis
TRMKKQIIERLTRYVKIDTQSNPDSKTTPSTNKQWDLLNLLEEELQSLGLKTDMDEHGYLFATLESNINYNVPTVGFLAHVDTSPDFNASHVNPQIIEAYNGQPIKLGESQRILDPDVFPELNKVVGHTLMVTDGTSLLGADDKAGVVEIMEGIKYLIDHPDIKHGTIRVGFTPDEEIGRGPHQFDVSRFNADFAYTMDGSQLGELQFESFNAAEVTVTCHGVNVHPGSAKNAMVNAISLGQQFNSLLPLHEVPERTEGYEGFYHLMNFTGNVEKATLQYIIRDHDKEQFELRKKRMMEIRDDINVHYNHFPIKVDVHDQYFNMAEKIEPLKHIIDIPKRVFEALDIVPNTEPIRGGTDGSQLSFMGLPTPNIFTGCGNFHGPFEYASIDVMEKAVHVVVGIAQEVANSHQSYK

SEQ ID NO: 5529 - protein, 109 aa, Staphylococcus epidermidis
IVMKNIHQTEEFNSTIGSTDPVIIKFEADWCPDCKAMDMWIDPIVEKYNNYQWYVVDRDELEDVTTENDVMGIPSILIFQNGKKLAHLHSANAKSPEQVESFLTEHLDQ

SEQ ID NO: 5530 - protein, 504 aa, Staphylococcus epidermidis
KVMKMMSNLIILPMLLPFVCALILVFTKNKNRISKILSITTMIVNTMISIALLIYVVNHKPITLDFGGWKAPFGIQFLGDSLSLLMVSVSSFVVTLIMAYGFGRGEKRVNRFHLPTFILLLTVGVIGSFLTSDLFNLYVMFEIMLLASFVLVTLGQSVEQLRAAIVYVVLNILGSWLLLLGIGMLYKTVGTLNFSHLAMRLNHMENNQTITMISLVFLVAFSSKAALVIFMWLPKAYAVLNTELAALFAALMTKVGAYALIRFFTLLFDHHPSVTHTLLVFMACITMIIGAFGVIAYKDIKKIAAYQVILSIGFIILGLGSHTISGVNGAIFYLANDIIVKTLLFFVIGSLVYMSGYRNYQYLSGLAKREPFFGVAFVVVIFAIGGVPPFSGFPGKVLIFQGAITNGNYIGLALMIVTSLIAMYSLFRVMFIMYFGDADGEQVQFRPLPIYRKGLLSVLVVVVLAMGIAAPVVLKVTEDATNLNMKEDVFQKNVNTHLKEVNHK

SEQ ID NO: 5531 - protein, 655 aa, Staphylococcus epidermidis
WGVKKMRITELLTKETIAMDLDASDKSGVITELVNQLDKAGKLSDPVSFKEAIHNRESQSTTGIGGGIAIPHAKVAAVKTPAIAFGKSKEGVDYQSLDMQPAHLFFMIAAPEGGAQTHLDALAKLSGILMDEKIREKLIHAESPEEVLNIIDEADDEATKEEEAEANENATVSTDNSNQDNNEPYVLAVTACPTGIAHTYMARDALKKQAEKMNIKIKVETNGSSGIKNHLTEQDIERATGIIVAADVHVETDRFDGKNVVEVPVADGIKRPEELINTALDTNRKPFVAQGGSKKHDDNEEKLSPGKAFYKHLMNGVSNMLPLVISGGILMAIVFLFGANSFKPDSSEYNAFAEQLWNIGKNSAFALIIPILAGFIARSIADKPGFAAGLVGGMLAISGGSGFIGGIIAGFLAGYLTQGIKYITRKLPQAIEGLKPTLIYPLLSVSITGLLMVYVFNPPAAWLNHLLLNGLNSLSGSNIMLLGLVIGAMMAIDMGGPFNKAAYVFATAALTEGNAAPITAAMIGGMIPPLAIATAMLIFRRKFTKEQRGSIVPNYVMGLSFITEGAIPFAAADPLRVIPSMMVGSGVAGAIALGLGSSIKAPHGGIFVIIGTDFNHILQTLIALVVGTLVSALIYGFLKPKVTENEIQASQAMDE

SEQ ID NO: 5532 - protein, 262 aa, Staphylococcus epidermidis
IFKNIYCLYKKGVTMRDKDNQHSRLYYIILTIVIIAICVVVVILFNTLKTNRSHSTDRYADFTELKKDTIKNKDWRIKTKHRKNKDILVTAIHGGGIEPGTTEIARRISNVGKYNFYTFEGLRKSNNDQLHVTSTHFNEPILDKLLKNTKETLSIHGFSGDDPIVYIGGKDKEMSHSITKELRKKDFTVKESPNKIDAKSSDNIANKNESNSGVQLELTTALRKQFFKHYKLDRHTRSDSDKYTKDFYKFANAVQKGIEKVN

SEQ ID NO: 5533 - protein, 325 aa, Staphylococcus epidermidis
FLKKKLNKGALLMVNRRKISIIGAGHTGGTLAFILAQKELGDIVLIERQQSEGMAKGKALDILESGPIWGFDTSVHGSVNIEDIKDSDIVVMTAGIPRKSGMTREELVQTNEQIVRETALQIATYAPHSIIIVLTNPVDVMTYTAFKASGFPKERIIGQSGILDAARYRTFIAQELNVSVKDVNGFVLGGHGDTMLPLINNTHINGIPVKHLISEEKIDQIVERTRKGGAEIVALLGQGSAYYAPATAIYETIDAIFNDRKRLLPSIAYLEGEYGCSDICFGVPTIIGYQGIEKIIEVDMNNDEYQQLQHSAQAVSEVKNSLKFK

SEQ ID NO: 5534 - protein, 283 aa, Staphylococcus epidermidis
IQFDSRFSWWKLLHIFACQKEKCKLIQIRNLDKTIDNKPILKDISVDIKKGKLTSLIGPNGAGKSTLLSAISRLFSYENGSILIEDKEISEYKTDDLAKKLSILKQSNHTDMNITIEQLVKFGRFPYSKGRMKQEDYDKVEYALDLLQLNEIKHRNIKTLSGGQRQRAYIAMTIAQDTDYILLDEPLNNLDMKHSVQIMQTLRDLCRQLNKTIIIVLHDINFASCYSDDIIALKQGELVKADDKDNVIQSDILKSLYEMEVRIEEIRGQRICLYYDETTFDSV

SEQ ID NO: 5535 - protein, 61 aa, Staphylococcus epidermidis
TCSDFFDASFCMSPYVPPIYLNTISVVKKRNFNIIQPNYITFMFFKCLNNMSFNLQDMLVL

SEQ ID NO: 5536 - protein, 423 aa, Staphylococcus epidermidis
SMHESIKIHIGRCQMFLLVNIIGLFIFLGIGVIFSRNRKNIQWKSIFILVILNLFLAWFFIYFPWGRAGVKGAANGIAWVIESAHEGTGFAFKSFTSNKMMDMAVSALFPILLVVPLFDILMYFNILPKIIGGIGWVLAKVTRQPKFESFFGVEMMFLGNTEALAVSSEQLKRMNEMRVLTIAMMSMSSVSGAIVGAYVQMIPGELVLTAIPLNIINAIIVSCILNPVSVEEQEDVVYSIKDHQTERQPFFSFLGDSVLAAGKLVLIIIAFVISFVALADLIDRLIHLITHLIANGIGVKGSFGLDQILGVFMYPFALLLGLPFNEAWEVAQQMAKKIVTNEFVVMGEISNQVNAMTPHHRAVISTFLVSFANFSTIGMIIGTLKGIVDKKTSDFVSKYVPMMLLAGILVSLLTAAFVGLFAW

SEQ ID NO: 5537 - protein, 659 aa, Staphylococcus epidermidis
RKNDSLLKTEETNMSLPKKKIGIFAFFLLTVFTITLKTYFSYYVDFSLGVKGLVQNLILLMNPYSLIALVLSVFLFFKGKKAFWFIFIGGFLLTFLLYANVVYFRFFSDFLTFSTLNQAGNVESMGGAVSASFKWYDFVYFIDTIIYLAILIFKRKWLDNRAFSKKFVPVVMATSVALFFLNLAFAETDRPELLTRTFDHKYLVKYLGPYNFTVYDGVKTIENNQQKALASEDDLTKVLNYTKQKRTEPNPEYYGAAKKKNIIKIHLESFQTFLINKKVNGKEVTPFLNKLSSGNQDFTYFPNFFHQTGQGKTSDSEFTMDNSLYGLPQGSAYSLKGDNTYQSLPAILDQKQGYTSNVMHGDYKTFWNRDQVYKHFGIDNFYDATYYDMSDDNIVNLGLKDKPFFKASADYQSKMKKPFYSHLITLTNHYPFTLDEEDASIDKPNTGDSTVDGYIQTAHYLDQALEEYITDLKKKGLYDNSVIMIYGDHYGISENHNNAMEKLLGEKITPAKFTDLNRTGFWLKVPGKSGGVNKEYAGQMDVMPTLLHLVGIDSKNYLMFGSDMFSKQHNNVVPFRNGDFITEDYKYVNGKIYSNKDNELLTEKPKDFDKNKKQVEKDLEMSDSVLNGDLFRFYKNPDFKKVNPGKYEYKSGPKGNEKK

SEQ ID NO: 5538 - protein, 249 aa, Staphylococcus epidermidis
LLLEVNHLNLFLGKKHILKDITFSLPINGEIIGIVGPNGAGKSSLLKAFIGEFKATGKHTLYDHPIHTQLRYITYIPQKAHIDLDFPIKVDQVILSGCYEDIGWFKKASVVEKTKLNQLLNDLELDHIRHRQIAELSGGQLQRVLVARALMSNSDIYCLDEPFVGIDIYSEQLIMKKIKHLRHMGKLILIVHHDLSKADQYFDRILLLNQSLQFLGPTKEALSSERLNATFINYKDDSLLTLSSQGSTN

SEQ ID NO: 5539 - protein, 113 aa, Staphylococcus epidermidis
IFLEVNRMAIKLSSIDQFEQVLEENKYVFVLKHSETCPISANAYDQFNKFLYERDIDGYYLIVQQERKLSDYIAEKTNVKHESPQAFYFVDGEMKWNADHDDINVSQLAQAEE

SEQ ID NO: 5540 - protein, 275 aa, Staphylococcus epidermidis
GDLDMSDLFQNAPPYIQALIAGIITWLLTALGAAAVFIFKKVNDKVLNSMQGFAAGIMIAASFWSLLQPAIESSENSAMPWLPAAIGFILGGVFIRVLDYIIPHIHQNAQDKNQQQEGVPTSLGKNALLVLAITLHNIPEGLSIGVAFGGVVSGNSHATFLGAIGLAIGIGIQNIPEGAALSMPIRAAGATRWKAFNYGQASAIVEPIFATIGAAAILVVNPILPYALAFAAGAMIFVVVEELIPDSQSSNNTDLATLSLMIGFTIMMILDVALG

SEQ ID NO: 5541 - protein, 95 aa, Staphylococcus epidermidis
MLSLYVMKTLFLIINIVLLKRFLLKLVGISFFMKVGIIKYFDVLLLLDKTFIKFPKNMKKLLKKENRVYNIDVNDNHYHYHYHYFRILTLYIFNI

SEQ ID NO: 5542 - protein, 327 aa, Staphylococcus epidermidis
IRIEKRVRKGECSMSFASDMKNELTRIEVDESNAKAELSALIRMNGALSLSNQQFVINVQTENATTARRIYSLIKRIFNVEVEILVRKKMKLKKNNIYICRTKMLAKEILNDLGILKKGVFTHDIDPDMIKDDEMKRSYLRGAFLAGGSVNNPETSSYHLEIFSQYEDHSEGLTKLMNSYELNAKHLERKKGSIAYLKEAEKISDFLSLIGGYQALLKFEDVRIVRDMRNSVNRLVNCETANFNKTVSAAMKQVESIQLIDEEIGLENLPDRLREVAKLRVEHQEISLKELGEMVSTGPISKSGMNHRLRKLNELADKIRNGEQIEL

SEQ ID NO: 5543 - protein, 254 aa, Staphylococcus epidermidis
DMSDSITIIDENKVIDVVLIAGRILLEAGAETYRIEDTMNRIAHSYGLHDTYSFVTSTAIIFSLNDRTSTKLIRIRERTTDLEKIALTNSLSRKISSKQLTIDEAKSELLQLKRASLQYSFLTNLIAAFVACGFFLFMFGGVASDAWIACLAGGIAFLTFSFVQKYIQIKFFSEFVASAVVISIAAIFTKLGIAKNQDIITIASVMPLVPGILITNAIRDLLAGELLAGMSRGVEAALTAFAIGAGVAIVLLLL

SEQ ID NO: 5544 - protein, 596 aa, Staphylococcus epidermidis
MVLEKQKLTLLYTQRNGVTRRRKMVFEGVIPNIDRRYHESPSEYTREMMSKYMTELPCETCHGKRLSKEALSVYVGDYNIGEVVEYSIKNALYYFENLKLSDQDKSIADQILKEIISRLSFLNNVGLEYLTLDRSSGTLSGGEAQRIRLATQIGSRLTGVLYVLDEPSIGLHQRDNDRLINTLKEMRDLGNTLIVVEHDDDTMRAADYLVDVGPGAGNHGGEVVSSGTPNKVMKDKKSLTGQYLSGKKRIEVPEYRREITDRKIQIKGAKSNNLKNVNVDFPLSVLTVVTGVSGSGKSSLVNEILYKALAQKINKSKVKPGNFDEIKGIDQLDKIIDIDQSPIGRTPRSNPATYTGVFDDIRDVFAQTNEAKIRGYQKGRFSFNVKGGRCEACKGDGIIKIEMHFLPDVYVPCEVCDGKRYNRETLEVTYKGKNIADVLEMTVEEATHFFENIPKIKRKLQTLVDVGLGYITLGQQATTLSGGEAQRVKLASELHKRSTGRSIYILDEPTTGLHVDDISRLLKVLNRIVENGDTVVIIEHNLDVIKTADHIIDLGPEGGEGGGTIIATGTPEEIAQNKGSYTGQYLKPVLERDSVE

SEQ ID NO: 5545 - protein, 133 aa, Staphylococcus epidermidis
INQEGILVAVPSEFKYSKEHEWVKIENNVATIGITEYAQNELGDIVFVELPETDDELNEGDTFGSVESVKTVSELYAPISGKIVEVNEELEDSPEFVNESPYEKAWMVKIEISDDSQLEELLSADQYSEMIGE

SEQ ID NO: 5546 - protein, 111 aa, Staphylococcus epidermidis
FFKEDTSLAKVYGSLIDNETRCTHYYSSLDVIAIKFKCCNKYYPCYKCHNEHVSHTIERWAENEFDEKAIMCGVCKHEMRIRDYMMVEMCPRCKAHFNSRCKFHYHLYFEV

SEQ ID NO: 5547 - protein, 316 aa, Staphylococcus epidermidis
TKKERFNVKKILALAIAFLIILAACGNHSNHEHHSHEGKLKVVTTNSILYDMVKRVGGNKVDVHSIVPVGQDPHEYEVKPKDIKALTDADVVFYNGLNLETGNGWFEKALDQAGKSTKDKNVIAASNNVKPIYLNGEEGNKNKQDPHAWLSLENGIKYVKTIQKSLEHHDKKDKSTYEKQGNAYISKLEELNKDSKNKFDDIPKNQRAMMTSEGAFKYFAQQFDVKPGYIWEINTEKQGTPGQMKQAIKFVKDNHLKHLLVETSVDKKAMQSLSEETKKDIYGEVFTDSIGKEGTKGDSYYKMMKSNIDTIHGSMK

SEQ ID NO: 5548 - protein, 236 aa, Staphylococcus epidermidis
NLREYFIMKSTAQLTKENNVKALRLNNTDREIFENYMTYVRADLRVNPHDSELMLNRTLKHLIRAGDTGMLAMEFFNHDPKAHAKKEIRELPNETFKNIFKYISHNFILLIGIFCFLKGLIGFFIGGDSNLLYLYTFPLTVIIGLVIIFLFIWMNFKTVQLQCFNNSYWTWWLTYGVIALLLITLFYVFFIPQSFLAFGPYIKVSNWTFIIIAIIIIPISFYVNHHFYNKEANTRI

SEQ ID NO: 5549 - protein, 336 aa, Staphylococcus epidermidis
KWREIMKQMNVVLIGGGTGLSVLARGLREFPIDITAIVTVADNGGSTGKIRDVMDIPAPGDIRNVIAALSDSESILTQLFQYRFGENQVDGHSLGNLVIAGMTNITNDFGHAIKELSKVLNIKGQVIPSTNASVQLNAVMEDGEIVHGETNIPKTHKKIDRVFLEPSDVEPMNEAIEALEQADLIVLGPGSLYTSVISNLCVKGISEALLRTSAPKLYVSNVMTQPGETDNYDVKEHIDALTRQVGEPFIDFVICSSESYSKDVLQRYEEKNSKPVAVHKEQLKDSGIRVLTASNLVEISNEHYVRHNTKVLSKMIYELALELTSTIRFTPSDKKK

SEQ ID NO: 5550 - protein, 337 aa, Staphylococcus epidermidis
NGLLFCRGNEGEKVIKFKNVTKRYANNIAVDNVSFNIKEGEFFVLIGPSGCGKTTTLKMINRLIPLSEGYIYFKDKPISDYPVYEMRWDIGYVLQQIALFPHMTIKENIAQVPQMKKWKDNDIDLRVDELLTMVGLNPEQFKNRKPDELSGGQRQRVGVVRALAADPPVIIMDEPFSALDPISREKLQDDLIHLQTQIKKTIVFVTHDIQEAMKLGDRICLLNEGRVEQIDTPDSFRTRPKSDFVKQFMGSHLDTTHNIVNQVKIKDLGINRSVDDNASVIHYPEVDAELYLNNIYEDLSHYDAVVVNDKEQHRRYLLNREDVFTYLSLNKEEATHE

SEQ ID NO: 5551 - protein, 374 aa, Staphylococcus epidermidis
GMSLFIIGTKFFKISVNLRCDLCMKKQLDQLTAYTPGLSPESLKKQYGIKGELHKLASNENVYGPSPKVKTAIQSHLDELYYYPESGSPKLREAISQQLNVDASRILFGAGLDEVILMISRAVLSPGDKIITSESTFGQYYHNAIVESADVIQVPLKDGGFDLDGMLQQIDNKTSLIWLCNPNNPTGTYFSHDELFNFLKRVPSDIPVLIDEAYVEFVTADDFPDTLKLQEDFDNAFLLRTFSKAYGLAGLRVGYVIASEDAIEKWNIIRPPFNVTRISEYAAIAALEDQEYLKEVTQKNSFERDKFYQIPQSQHFLPSQANFVFVKTSRSQALYDALLNVGCITRLFPNGVRITIGLPEQNNKMIEVLKHFEY

SEQ ID NO: 5552 - protein, 63 aa, Staphylococcus epidermidis
LKQLIISQLSTQSSSAIILKNFEQRITPLYSSYYITSSPISCGFILPSYNINNIFYTRYGGIS

SEQ ID NO: 5553 - protein, 319 aa, Staphylococcus epidermidis
LHKLFIESRYIFMKQPYNHGVLFYHEHSGLKDIHNGIGEVAKSLSSMCKHLSLQLSENKGDIIKYCKSIKNENYSSDVDVLFILGGDGTLNELVNGVMQYQLNLPIGVIPGGTFNDFTKTLQLHPNFKTASEQLLTSHAESYDVLKVNDLYVLNFVGLGLIVQNAENVQDGSKDIFGKFSYIGSTVKTLLNPVKFDFSLTVDGETKEGNTSMMLIANGPNIGGGQIPLTDLSPQDGRANTFVFNDQTLNILNDILKKRDSMNWNEITQGIDHISGKHITLSTNPSMKVDIDGEINLETPIEIQVLPKAIQLLTATEQNN

SEQ ID NO: 5554 - protein, 81 aa, Staphylococcus epidermidis
VNSCKIKFCRFSDITAIPPLIHLYCNGYAYIFQSKSSIFNQKQSFYDKNKNTFQIRCLKWIVSSHFKTYILIFRNHFLSIK

SEQ ID NO: 5555 - protein, 374 aa, Staphylococcus epidermidis
YNDWKFKDGEKMRLIIKKIYIIAIVLLNMVFKPFNINSKHIVIMMTFKQDILPIIEALCSEGYHVTVIGKKIYQKDINNINHAYFIPAGNKYIMRHMKVLSKAKVIILDTYYLMMGGYQKKKGQTVIQTWHAAGALKNFGLTDHQVDLKNKAMVRQYKKVYDATDYYLVGGEKMAQCFIQSFDASPSQMLKFGLPRLTQYFRSNLKLEQQRLKKKYHITNKLAVYVPTYREGQVAQRTIDKENFERHLPNYTLLSHLHPSTVDCQTSHSIDVTSLLIMADIIISDYSSLPIEASALNKPTLIYNYDEQQYEKVRGLNEFYYAIPERYKMSNEESIIQAIQDNDEQFQSLFNDWHQYNSKDSLNQLVHFINKLVK

SEQ ID NO: 5556 - protein, 226 aa, Staphylococcus epidermidis
EYRLILILRRCLIMGMHQYFKRLSDLEKLIRLPGKFKYFEHNVAAHSFKVTKIAQYMATVEEYHGNKIDWKSLYEKSLNHDFAEVFTGDIKTPVKYASKELKHLFSQVEEEMVDTFIKEEIPTQYQHVYRERLQEGKDDSLEGQILSVADKIDLLYETFGEIQKRNPEPLFFEIYEMSLETIIQFDHLESVKDFIENVIPEMLTENFIPRTELRETTMSILNRRNG

SEQ ID NO: 5557 - protein, 367 aa, Staphylococcus epidermidis
FSLCNSKEVNIHMGLNKEAIKIGFAYVGIVVGAGFSTGQEVMQFFTPFGLWSYIGVIISGFILGFIGRQVAKIGTAFEAKNHESTLQYVFGKKFSKVFDYILVFFLFGIAVTMIAGSGSTFEQSFGIPTWLGALIMTVLIYLTLLLDFNKIVRALGLVTPFLIIMVILIAVFYLFTGSISLGEVNSAMPETSAWKGIFWGLVYGGLAFAVGFSTIVAIGGDASKRRVSGAGAMFGGVLYAILLALINFSLQTEYSKIKDVAIPTLNLAKGIHPWLGLVLTVIMLAVMYNTILGLCYSFAARFTEPYSKKYHIFIIIMMVMAFILSFVGFADLINVLYKFMGIVGLFIVVAVLIKYYKRKKDDEEHIA

SEQ ID NO: 5558 - protein, 277 aa, Staphylococcus epidermidis
EKAWLSLMFAVGTVLKEHIKNFYLIQRLAQFQIKITNHNNYLGIAWEVLNPALQIMVYWLVFGLGIRSNAPIHGIPFVFWLLVGISMWFFINQGVLEGTKSISQKFNQVAKMNFPLSIIPTYIVTSRFYGHLGLLAIIIIACMFNGIIPSIHIVQLLIYVPFAYLLTSSVALLTSTLGILIRDTQMIMQALMRILFYMSPILWVPKNHGVSGLIHQIMLFNPVYFIAESYRAAILFHQWYFIDHWKLMLYNVIIILLFFIVGSILHRRYRDHFADFL

SEQ ID NO: 5559 - protein, 201 aa, Staphylococcus epidermidis
VKRCLQLVKTLYLMRHGQTVFNLKGKIQGASDSPLTALGVQQANAAQQYFKTKNIHFDYLYSSPQQRACDTLENAVPNQQYWCVKDLKEWGFGLFEGESIELLRAIKQPRYLYGDAVVPFGGESRSEVEHRVYRALYEMMDTTDGETILAVSHGSTIGLFVRNILGYDKGSKFEIGNCNIVKFEYDGEEFIFKDLINPIKK

SEQ ID NO: 5560 - protein, 137 aa, Staphylococcus epidermidis
GEFRIMKRVITYGTYDLLHYGHIELLRRAREMGDYLIVALSTDEFNQIKNKKSYYDYEQRKMMLESIRYVDLVIPEEGWGQKEKDVDRFDVDVFVMGHDWEGEFDFLKDKCEVIYLNRTEGISTTKIKQELYGKDTK

SEQ ID NO: 5561 - protein, 270 aa, Staphylococcus epidermidis
VCLRKKIIWLKYDRSDYLSILEVRQLSKVYGDKQAFQEVLKEINLDVDEGEFISIMGPSGSGKTTLLNVLSSIDYMTKGSITINGKQLEKLSNKQLSDIRKKDIGFIFQDYNILNTLTVKENIMLPLSVQKLDKQIMHERYQRIVEALNISDISDKYPSELSGGQRQRTSAARAFINLPSIIFADEPTGALDSKSTLDLLKRLKYMNEEFNTTILMVTHDPVAASFSNRVVMLKDGQIFTELYQGDDDKQTFYKEIIRTQSVLGGINYEL

SEQ ID NO: 5562 - protein, 226 aa, Staphylococcus epidermidis
KRIRALQQDINNYMIPEFKKYKNSTQHLTADTNEVKHLKEDYLKTVENKEKSIYDLKEFVDLCNRSIKDNEDILDYTKLFEKNRTEVESDINKAQNKEDASQLKSKLEENNQQLKDTAKKYLNSSNNDSDSAKEAIKNHISPLIDKQITDINKTNISDNHVDNARKNAIEMYYSLQNYYDTRVDTIKTSEKLAQIDVDRLPKEGKDISEMDKSFKREFKKIRESVN

SEQ ID NO: 5563 - protein, 73 aa, Staphylococcus epidermidis
ELHRKKKGYKMKDTQLTYILLIIASILLIANGIFAFERTLSMILMSILFILVGIILLSTTLNTMYQSSKHSKR

SEQ ID NO: 5564 - protein, 178 aa, Staphylococcus epidermidis
VIILRRLSKEKHHQVNPLWHIYRKIKFVKVLKQTLIIEIARFVPSMKLKNKIYKKLLKMDVGNHTSFAYKVLPDLFYPEYISVGKNTVIGYNTTILTHEVLVDEWRVGKVIIGDYTLIGANTTILPGITIGNHVKIGAGTVVSKDVPDYSFAFGNPMQIQLDSGGDNEWHKKKITSFQ

SEQ ID NO: 5565 - protein, 203 aa, Staphylococcus epidermidis
IIYRVLIHEFGHVLFNKLAGGKAKDLVIVTSPRERKVTSQQGYAITQSKGYLGQFITTIGGYLMPPLMFLTGLVSIHYQYPSIFITIYLFIFIYYFFITSRKLSPLIVIILISSLLYLVFKQDHQWFIYDIVTLSYHFILGVLLGEILQSSWTIFRLTFQRPKPSWDGSALTKVTRVPTFIFSLVWILFNLYTVYLLIKYTIL

SEQ ID NO: 5566 - protein, 155 aa, Staphylococcus epidermidis
VFIRYLITKIGGGKMKENDVVLKSVTKIVVFILLTFGFYVFFAGHNNPGGGFIGGLIFSSAFILMFLAFDVNEVLKSLPIDFKKLMIIGSLISVATASVPMFFGKPFLYQTEANVTFPLLGHVHVTTVTLFELGILLTVVGVIVTVMLSISGGRS

SEQ ID NO: 5567 - protein, 344 aa, Staphylococcus epidermidis
IVQRMEASRFTLFKYCFVNIVIKKVLKERVMNKYRSVIIWLFILILSMSLSLSWDVGKLDDVFNQTILFQVRLPRLLEAMLTGAVLTLAGQVYQIVLNNPLADSFTLGLASGASLGSGIALFLGLSFLWFPIFSIIFSLITLLLVLSVSAMLAKGYPVQMLILTGLLFGALLNALLYLLVLINPKKMNPIASYLFGGFASAEYQDVMIISLIASVAIIVLFLMQKGIKLLQVGELKSQSLGLNVQQVTYIVLIVASIMTAVVVAYVGVIGFIGMIIPQLIRKFYWRYQIGLQMLLNIIIGAVVMIIADFIGSTMIQPIQIPVGIVMALLGVPVLFYILIKQTNI

SEQ ID NO: 5568 - protein, 165 aa, Staphylococcus epidermidis
NLKRMIKYIYWWVSIKYIQFEEVIMMAVQYETKATNVGGRKGHVHTDDNAINVDVLPPQQADGKATNPEQLFAAGYASCFNGAFDLILKQNKVRDAEPEVTLTVRLEDDPDAESPKLSVDIHAKVKNVLSQEDAEKYLQDAHDFCPYSKATRGNIDVNLNVEVVE

SEQ ID NO: 5569 - protein, 557 aa, Staphylococcus epidermidis
GDKRMNIIDQVKQTLIEEIEASIRKANLAEDIPEIKIEIPKDTKNGDYSSNIAMVLTKIAKRNPREIAQAIVDHLDTSKAHVKQVDIAGPGFINFYLDNQYLTDIIPEAITKGDRFGYATQSKNTNILLEYVSANPTGDLHIGHARNAAVGDSLANILIAAGYNVTREYYINDAGNQITNLARSIEARYFEALGDTSYEMPADGYNGKDIIEIGKDLAVKHPEIKDYSDEERLKTFRQLGVDYEMEKLKKDLSDFNVHFDNWFSETSLYENGAIKNTLSKMKELGYTYEADGATWLRTSDFKDDKDRVLIKKDGNYTYFTPDTAYHYNKINRGNDILIDLMGADHHGYINRLKASLETFGVDSDRLEIQIMQMVRLMQNGEEVKMSKRTGNAITLREIMDEVGIDAARYFLTMRSPDSHFDFDLELAKEQSQDNPIYYAQYAHARICSILKQAKEQGIEVSTDADFSKINNDKAIDLLKKVAEFESTIESAAEHRAPHRLTNYIQDLAAAFHKFYNAEKVLTDDTEKTKAHVAMIEAVRITLHNALALVGVTAPESM

SEQ ID NO: 5570 - protein, 77 aa, Staphylococcus epidermidis
MKFREWTITINGKGPINVVANEDTLLILQKYQHVEVALKIDNETVQVKSLGYNEDIIINHNTKEITINVTNLLEDDE

SEQ ID NO: 5571 - protein, 91 aa, Staphylococcus epidermidis
LNIRFTWNKGGLMMSTHSQCNYVNPNSISLDWECLIISKTDMLLDGVPKELINTWLDQNVIEPFCVRNNEINFKTKDVWNALKTHNWYYSN

SEQ ID NO: 5572 - protein, 569 aa, Staphylococcus epidermidis
GEDRSMKSHIHFSIDRDLICAIMVGVLSGIVTLAMFFLSGYMITQSALGAPLYALMILVVSVKLFGFLRAITRYIERLLSHKTTFTMLRNVRVQFLKMLYPVVPDIYRRFNSSDLITKMISRVEALQNIYLRVYYPPIVIGLTAIVSVITMLFLSPLHALVITLSMLLTLWIVPWLSAMKARKLKQQVTQTQKTFLKRYYDYKEGHEELKRFNRSDDFENTVSQSLRQFDDMQLKERRFLSIYDYLLNLIAMFSIFMCLVLGAQQIHDGQLNAIYITSIILMILTLFEQAVPMSNVAYYKADTDLALEEIQEVIVPKYKIPSEHTNLKRSQNLLLEIKNVTFKYEHQHHSTLKQINLTIEYGDKVAIIGPSGSGKSTLLHVLLGLYQIEEGEVRLNGKDMNSINDNDKYQTFNAMLQSQYIFDGSIRDNLFSEQSDDNLKKVLEDVGLEYLNLDSIVTLDGHNLSGGEAQRLSLARLLLRPSAGFWILDEPTTALDINNTQKIINLIESLSQTLIIATHDLEILPRFNKIIVMNDGEIIENDSYQELMQHDGYLKKVIEMNGNEMKFFN

SEQ ID NO: 5573 - protein, 145 aa, Staphylococcus epidermidis
FYQRKWTLNQLVDYFSRWLDETKGTFVHTQKQDHHYIIYNRNIKRPLAIFKMVNTTEDIITLHLVDGKLMKPKSKKQAKLEFRLLKGTRLIMVHLYDYIPRLFWPIYYFIQAPIQGLLMRGFEIDCRIKHYQGRIQSGEKIKYTK

SEQ ID NO: 5574 - protein, 206 aa, Staphylococcus epidermidis
YNKSKELVTVKVKYIDKRHWRRLVEREYTEVKVNNNRFKGIIGLVTMKKVREPLEVTVVGQNIIVADDNYKWLQILPDKKRYSMTVMFDNKGNPLEYYFDINIKNITQKGNARTIDLCLDVLVLPNGEYELVDEDDLMYALQNKQISKKQYHEAYIIAHQLMIEIEDNFSEIQDKVMRCYHKINHKAQKMKHKRPYKAKKKSHRRH

SEQ ID NO: 5575 - protein, 159 aa, Staphylococcus epidermidis
FCKRSTIMTDSNAKEIRTGRLIAISSLVFCILLIIHHFIVLDESTAKSILSLAGQKTSDTAVKNILNSDRYTGIMYILAYLAGTVAFWNRHPYLWWFMFAVYISNALFTLVNLYLFIQGILDVKNVLAVLPILIVVIGSIILAIYMLVVSITRKSTFNR

SEQ ID NO: 5576 - protein, 683 aa, Staphylococcus epidermidis
RGESVEIFETLLIFVALVIVSSFVHTFIPKVPLAFIQIFLGMILYLTPIPVEFNFDSELFMVTLIAPLLFVEGVNVSRVHLRKYIKPVMMMALGLVITTVIGVGLFIHWIWPELPIGAAFAIAAILCPTDAVAVQAITKGKVLPKGSMTILEGESLLNDAAGIISFKIAVGVLITGTFSIFDAIQQFLIASIGGAIVGLIIGMALVRFRLTLMRRGIENINMFTFIQLLTPFVTYLIAELFHASGIIAAVVAGLVHGFERDRIAQTRTQLQMSYNHTWSILGYVLNGFVFSILGFLVPEVIVKIIKTEPHNLLFLIVITLLVALAVYLFRFVWVYVLYPYFYLSVSPFQKMISKNDEDKVTESKPKRSLYALIMTLCGVHGTISLAIALTLPYLLANHETFAYRNDLLFIASGMVILSLIIAQVILPLVTPDSPEVKIGNMSFKEARIYILEHVIDYLNQKSTFETSYRYGNVIKDYHDKLTFLKTVEKEDENSKELERLQKIAFNVETKTLEKLVDDGEITESVLENYMRYAERTEVYKQASLLRRIIVGLRGMLLKRRVKTKINSASSLSVTDNLLELGKINKLVHYNVVSRLAKEATTDNKLEVGMICDGYLMRIDNLTPNNFFNSRHEDTLTKIKLNALREQRRILRELIENDEITEGTALKLRESINYDEMVIVDSMT

SEQ ID NO: 5577 - protein, 103 aa, Staphylococcus epidermidis
EERRTMHEQDFNILEGKKMTLVELGRELENLTGRTIKDTTSDIKRVIAHLPNFESDTDTFVATYHLNHQNDFIDATFVAPKNQSDRLKEIPVHIKLISYISKN

SEQ ID NO: 5578 - protein, 249 aa, Staphylococcus epidermidis
NIKRSLKMNLNCIKAIVFDLEGTLLDRVKSREKFIEEQYERFHDYFIHVQLADYKNKFIELDDDEDNDKPDLYKEIIKQFHIDRLKWKDLFNDFEMHFYRYVFPYYDTLYTLEKLSKHHYMIGVIANGKSKIKQFRLHSLGIMHVINYLTTSETVGYRKPHPKIFEDMIDQLGVKPSEIMYVGDDALNDVAPARAMGMVSVWYKQEDAELEPLTEEVDYTITTIEELLKILPDNFETEGEEQHGNGFNY

SEQ ID NO: 5579 - protein, 178 aa, Staphylococcus epidermidis
FGKSCTIMFVNYFTISKEWLYMLSVTKKNTYESNKDEVTQMIDSLAEKGQEALKELSKKSQHEINDIVHQMSMAAVDQHMHLAKLAYDETGRGIYEDKAIKNLYASEYIWNSIKDNKTVGIIGEDKQKGLTYVAEPIGVICGVTPTTNPTSTTIFKAMIAIKTGNPIIFAFHPSAQQS

SEQ ID NO: 5580 - protein, 104 aa, Staphylococcus epidermidis
IKESMIKMNEDNRNKQIKFERNLITFPYLGFAFIVLLFNIFYTDVKITMVLFGLFFAYNLGMLFIAFIRHFKRTLILTLILTILSGIAFFVLLYVFGLNHDIFG

SEQ ID NO: 5581 - protein, 154 aa, Staphylococcus epidermidis
NVWRRTLMSEQHNLKEQLCFSLYNAQRQVNRYYSNKVFKKYNLTYPQFLVLTILWDESPVNVKKVVTELALDTGTVSPLLKRMEQVDLIKRERSEVDQREVFIHLTDKSEMIRPELSNASEKVATASSLSKEEVKELNRLLGKVIDAFIETKEK

SEQ ID NO: 5582 - protein, 101 aa, Staphylococcus epidermidis
HSRRQILMENLTKEQKYTIAKFYKLYMERSNAGQPEEEANHFKDSVTAQDDYFCDRKYEDFIHNCKVLINEGYLDGEVEDNKIYNIQVTTKAFTEIERSFG

SEQ ID NO: 5583 - protein, 312 aa, Staphylococcus epidermidis
FYRREIMIYTVTFNPSIDYIIFTDGFEISGLNRAKATYKFAGGKGINVSRVLKTLDVDSTALGFSGGFPGDFIAQTLEDSNIQSDFVQVDEDTRINVKLKSGQETEINAPGPKVTHAQFEQLLSQIRRTTNDDIVIVAGSVPNSIPSDAYAQIAQITEKTGAQLVVDAEKDLVETVLPYRPLFIKPNKDELEVMFNTTVKSDEDVIKYGKEILKKGAQSVIISLGGDGAIYVDQHQSIKAVNPQGHVVNTVGSGDSTVAGMVAGLSMGLNIDEAFQQAVASGTATAFSEDLATRDAIENIKSQVTISVLDGE

SEQ ID NO: 5584 - protein, 801 aa, Staphylococcus epidermidis
RCRRERRGIMNLKQSIEEMIKQPDYEPMSVSDFQDALGLNSADSFRDLIKILVELEQSGLIERTRTDRYQRKQSNKTNSKLIKGTLSQNKKGFAFLRPEDDEMDDIFIPPTKINRALDGDTVIVEIQKSRGEHKGKIEGEVKSIEKHSVTQVVGTYSEAKHFGFVLPDDKRIMQDIFIPKGQNLGAVDGHKVLVQITKYADSTDNPEGHVSAILGHKNDPGVDILSIIYQHGIEIEFPDDVLQEAEEVPDVIEPSEIEGRRDLRDELTITIDGADAKDLDDAIAVKKLKNGNTELTVSIADVSYYVKEGSALDKEAYDRATSVYLVDRVIPMIPHRLSNGICSLNPEEDRLTLSCRMEINERGEVVKHEIFDSVIHSNYRMTYDAVNKIITDQDSEIRSQYKDLTPMLDLAQDLSNRLIHMRKRRGEIDFDINEAKVLVNDEGIPTEVLMRERGEGERLIESFMLAANETVAEHFNKLEVPFIYRVHEQPKSDRLRQFFDFITNFGIMIKGTGEDIHPTTLQSIQEEVEGRPEQMVISTMMLRSMQQAHYDDVNLGHFGLSAEYYTHFTSPIRRYPDLTVHRLIRKYLIENSMDKKEIRHWEETLPELAEHTSQRERRAIEAERDTDELKKAEYMIQHIGDEFEGIISSVANFGMFIELPNTIEGMVHIANMTDDYYHFDERQMALIGERQAKVFRIGDTVKVKVTHVDVEERMIDFQIVGMPLPKKTSSQRPAREKTIQAKTRGKSLDHTKSDRNGKGKKKKRKQRKGKNARKKDKQGNTHHKPFYKDKSVKKKSRRKKK

SEQ ID NO: 5585 - protein, 174 aa, Staphylococcus epidermidis
QNRSVDMTHLIREISIKDVENFISLLSQIYDESEFTFYNPGEYLPTISSASQHLEKYITSPTKAIYVAESDEQLVGYVFVNTETYERTQHEAVVYLGVREYYQHQGIGQALINRIEAWALNHHIRRIEATVVTENINAIELFKGMGFQIEGELKDKLFINQKYYNEYVMAKILN

SEQ ID NO: 5586 - protein, 69 aa, Staphylococcus epidermidis
NVFGTNNRNMSPKTINKGHSKALTGLNNFKSRQSSNGTYAKNKFNVIKLKICDSVIDITNKIIKYILAK

SEQ ID NO: 5587 - protein, 220 aa, Staphylococcus epidermidis
IVGGKNKMDKSIITIKQAHSIENVISKSRFIAYIKPVSTENEAKAFIDEIKTKHKDATHNCSAYTVGPEMNIQKANDDGEPSGTAGIPMLEILKKQEIHNVCVVVTRYFGGIKLGAGGLIRAYSGAVRDVIYDIGRVELREAIPVTVTLDYDQTGKFEYELASTTFLLREQFYTDKVSYQIDVVKNEYDAFIDFLNRITSGNYDLKQEDLKLLPFDIETN

SEQ ID NO: 5588 - protein, 354 aa, Staphylococcus epidermidis
IKLGGLFDLENKETNIQEYEEMMTDPDFWNDQTKAQDIIDKNNALKSIVNGYYQLTNAVDDMSATRELLQEEYDEDMKIELEEEVQQFEEQIDQYELQLLLDGPHDANNAILELHPGAGGTESQDWVSMLLRMYQRYCEQNGFKVETVDYLPGDEAGVKSVTLLIKGHNAYGYLKAEKGVHRLVRISPFDSSGRRHTSFASCDVIPDFNNDEIEIEINPDDITVDTFRASGAGGQHINKTESAIRITHHPTGIVVNNQNERSQIKNREAAMKMLKSKLYQLKLEEQEQEMAEIRGEQKDIGWGSQIRSYVFHPYSMIKDHRTNEETGKVDAVMDGEIGPFIEAYLRKEMDSRDV

SEQ ID NO: 5589 - protein, 231 aa, Staphylococcus epidermidis
QLKGDGLMRKCIQCNQPIHETIHIYNLFKPPQIFCERCETLWLNSKIHKDGRCPKCLNNKISTDGECHDCQFLSKTFYLMEQLFCDYSYDGMMKEIIHQYKIKRDFYLAEVLARKLVLPQTQYDYIVPIPSPIERDIERTFNPVTTVLDKMGISYQDVLGTHIRPKQSKLGKIERSKAPNPFYIKDEEINIEGKVILLIDDIYTTGLTIHHAGCKLYDKKVRKFKVFAFAR

SEQ ID NO: 5590 - protein, 226 aa, Staphylococcus epidermidis
YRKGVIIMSQSTHQSTDHKRQSQDKNQTHAYAKVWLYFMYYWMIFGIGCYFGQYLPMSWRKPLSLGLLILILATLFIKRARKYGLVISHIYAIIVGLLSYALFTTYLQNLGAEVFYKNIILAIGAFIAFGIIGYFLIKDASSMGKYLFVTLIALIIAGIIGIFINNPIFHTVITIVSLLLFLLYTLYDFNRMKRGQFSPREMGFNLFINLLNIIEDILSLANRFKN

SEQ ID NO: 5591 - protein, 67 aa, Staphylococcus epidermidis
RLRGSSTLIISLGRIDSNPRKMSFLFNVLNILSHLLNINIIISIIKVICEIWIYELIINIKWLCRTL

SEQ ID NO: 5592 - protein, 264 aa, Staphylococcus epidermidis
LKGGAKMNKIQICNQIELNYIDEGEGIPIILIHGLDGNLAGFKDLKNELKKQYRVITYDVRGHGKSSRTESYELKDHVEDLNDLMGALNIDSAHILGHDMGGIIASEFTEKYQYKVITLTIVSAKSEDIANGFNKLMVDYQEELAGFNKSEAMIILFSKLFKEKDKAMKWYQSQKLYNRPTPEESAIAVRALLNIKDLTRVHHNVSIPTLIVNGKYDPLIQNKSHYDMDQYYDQVTKIVFDNSGHAPHIEEPEKFLKLYLDFVS

SEQ ID NO: 5593 - protein, 258 aa, Staphylococcus epidermidis
IRGGIAVISEKRQNLILQELTQKDFLTLQDLVDRTGCSASTIRRDLSKLQNMGKLQRVHGGATIHQNRVKEPKLSEKRTQNLREKQEIAKRAACDIQDHECIFLDAGSSTFELIQYIEAKDITVVTNGMTHVEELLKHGIKTLMVGGQVKPTTMATVGANALETLRRYCFDRAFIGMNGIDVKYGLTTPDEQEALIKETAMKLSNHKYVLVDQSKFNQIYFARVPILDGLSIITSQKAMQSKMTEAYMNEFNFIGGKS

SEQ ID NO: 5594 - protein, 393 aa, Staphylococcus epidermidis
KKRGVPMKKQLFILYFNIFLIFLGIGLVIPVLPVYLKDLGLKGSDLGMLVAAFALSQMIISPFGGTLADKLGKKLIICIGLVFFAVSEFMFAAGQSFTILIISRVLGGFSAGMVMPGVTGMIADISPGADKAKNFGYMSAIINSGFILGPGFGGFLAEISHRLPFYVAGTLGVVAFIMSVLLIHNPQKATTDGFHQYQPELFTKINWKVFITPVILTLVLAFGLSAFETLFSLYTADKVNYTPKDISIAIIGGGVFGALFQVFFFDKFMKYMSELNFIAWSLLYSAIVLVMLVLANGYWTIMIISFVVFIGFDMIRPALTNYFSNIAGKRQGFAGGLNSTFTSMGNFIGPLVAGALFDVNLEFPLYMAIAVSLSGIIIIFIEKGLKSRRKEAN

SEQ ID NO: 5595 - protein, 151 aa, Staphylococcus epidermidis
RIFLHFIFFFTRIMVLRTSFFKFLKFLHFFLIHVIKSIDHFTCTFVYYSTKFYRSSGCISYKVFNIIFISIASIYICFKFKNLLLINPFINVIVRDNLFCFLSGNLFLSCFLFLITIRICYAPISLHIIRFILFFFWIAFCFFYIFLSTCC

SEQ ID NO: 5596 - protein, 309 aa, Staphylococcus epidermidis
ITFLTHCVIFIFNKIFYSLYTRLINLTTDVLYIIIYINVYKEGTKMSVSVNIENLTKEYRIYRNNKDRIKDALIPKNKNKTFYALDNVSLTAHEGDVIGLVGINGSGKSTLSNMIGGSISPSSGEITRHGDVSVIAINAGLNGQLTGVENIEFKMLCMGFKRKEIKKLMPEIIEFSELGEFIYQPVKKYSSGMRAKLGFSINITVNPDILVIDEALSVGDQTFTQKCLDKIYEFKAAKKTIFFVSHNIRQVREFCTKIAWIEGGKLKEFGELEEVLPDYEAFLKTFKKKSKAEQKEFRNKLDESRFVVK

SEQ ID NO: 5597 - protein, 455 aa, Staphylococcus epidermidis
NSLMILSSLLYNSYKEWWKFMSKVNKPLYFYLMLFLLTTLIGAFLLYLPYTGKKPINFIDALFVASSAFTVTGLSPVDVGTQFNIFGEIIILLLIQIGGLGIVTVAMLTLIFLNKKISINNRILFMITWNIDEPGGVIKLIKHLAIYSIATELFGTLCLCLSFIPKFGIGKGLFLSLFTSVSAFNNAGFALFKNNLIDFSNDPVIIITIPILIILGGLGHLVVVDLWNAKSFRKLSLHSKLVLTTTGLLILIGTVFFFLLENQNSMLHMGLIEKIGNAFFQSVTTRTAGFNTIDVGNIKTPTALLLMALMFIGGAPLSAAGGIKVTTFVIATIAIFNTIRKEKNNSIFNREISERYIQLSFVTILISIAFIGMVTFILTIINSNIPLIKILFEVVSAFGTVGLTMDLTSEYYNWTEFIIIIVMLCGKIGLLNISRALVPPKDPKNYRYTKGHIHL

SEQ ID NO: 5598 - protein, 241 aa, Staphylococcus epidermidis
DDIMGRKWNNIKEKKAQKDKNTSRIYAKFGKEIYVAAKSGEPNPESNQTLRLVLERAKTYSVPNHIIDRAIDKAKGAGDENYDHLRYEGFGPNGSMLIVDALTNNVNRTASDVRAAFGKNGGNMGVSGSVAYMFDHTATFGVEGKSVDEVLETLMEQDIDVRDVIDDNGLTIVYAEPDQFAQVQDALREAGVEEFKVAEFEMLPQTDIELSEEDQAIFEKLIDALEDLEDVQNVFHNVDLK

SEQ ID NO: 5599 - protein, 168 aa, Staphylococcus epidermidis
MIVIKGENMSKTKKTNAMRILDRAKINYQMNTYEVTDKHQHGEEIAQLVGAKIEEVFKTLVLENSNHEHYVFVIPVNETLDMKKAAHVVNEKKLNLMPLDQLKQVTGYVRGGCSPIGMKHSFKTTIDASAKNLEKVYISGGQRGMQIIIHVNDLIDMTKAQVESITQN

SEQ ID NO: 5600 - protein, 208 aa, Staphylococcus epidermidis
CVVMQSRYFARIYFIILFVISMTESHIFNFMTLNLFLAYVPFELCLLLKLFKPVKAFEWPLFIVFGLIFLLLVPNTFYMITDLIHLNQFQFNFLAGLNITEWIYFTYLILGVLLAIYLTILIFLEIAHFTSYVWLNRLLIVILMFLNGLGIYIGRFLRLHTVYLLNAPLKIVKEVFLIIDVKALLFVVLMVLIQATVILFIKGVRLYQ

SEQ ID NO: 5601 - protein, 79 aa, Staphylococcus epidermidis
GGIFMITKEDIVADVVTDYPKSADIFRNAGIDFCCGGQESIASAVNHKPNIDLNSLLNKLNHIDNTEGNSTINPGTFKW

SEQ ID NO: 5602 - protein, 302 aa, Staphylococcus epidermidis
GETMKRYLITGGTGMVGSHLVNEIKQTDAHITILTRQDKTSNHPKITYINWSKEGWQHQVPDIDIVINLAGATLNKRWTSSHKQAMMLSRIQSTQTLFELFETREHKPEVLFNASAMGYYPPDLFTSYTELYRTLPFDFLSEIVYQWERFANKFKQFGTRVVLGRFGLILSDDGGALEMMELPYRLYVGGKLGSGRQWYSWIHIDDLIRGILFTINHDNAEGPFNLTAPIPERQNLFGYTLARAMHKPHETWAPKLILRAVLGQMSTVILDTQKVLPNKLHALGFEFKYNNLRNALDDLIKA

SEQ ID NO: 5603 - protein, 287 aa, Staphylococcus epidermidis
GDAMKIDDYRLLITLDETKTLRKAAEILYISQPAVTQRLKAIEAAFGVEIFIRTKKQLITTTEGSMIIEHARDMLKRERLFFDKIQAHIGEVNGTISIGCSSLIGQTLLPEVLSLYNSQFPNVEIQVQVGSTEQIKAHHRDYHVMITRGNKVMNLSNTHLFNDEHYFIYPKDRKEDVTKLPFIEFQADPIYINQIKQWYNDHLGHDYHATITVDQVATCKEMLLSGVGVTILPKIMMKNIDKNMFEFEKVTIDKKPLIRSTYMSYDASMLQLPQVDAFVNLMLNFIR

SEQ ID NO: 5604 - protein, 66 aa, Staphylococcus epidermidis
PLYILSLPGDASDVCLYILLSQSPTPCFYYIKLGCQCHLKSQINTVYINVLIKSLRLFYYKLIYFT

SEQ ID NO: 5605 - protein, 297 aa, Staphylococcus epidermidis
SYNIEAMILNSKVKGIIAILISAVGFSFMSVFFRLAGDLPVFQKSLARNFVAMFIPLFFIYKYRQPMFGKLSSQPLLISRSTLGLIGVLLNIYAIDHMVLSDADTLMKLNPFWTIVLSLIFLHEKVRKYQITAMIIAIIGMLLIVKPEFSSSVIPSIAGLLSGIFAASAYTCVRALSTREKPYTIVFYFSLFSVVVLIPFSIFTYTPMTTIQILFLLGAGLSAAVGQIGITLAYSFAPAKDISIFTYASIIFTALFGFILFGESPDMFATVGYIVIIGASYYMFDKARRETTINQNN

SEQ ID NO: 5606 - protein, 117 aa, Staphylococcus epidermidis
GGNMRSVIKLENTFIFIITIAVYVKLEFSIWLFLLLLLVPDIFMLGYVINRKTGSYVYNIGHTYITPIIIALLYLYIDERLLLQISLIWLAHISIDRTLGFGLKYSSDTDKTIIQKM

SEQ ID NO: 5607 - protein, 386 aa, Staphylococcus epidermidis
GLNMHIEFKYRYYENEKDYEDYQLEMDNFQDSKIAYRLDEVGDVIHFAEQEQRNGSYVALYVTYEAAPFFNKEMVVNNVKQSHIFAAAYSFKSVNSIKNIKKVMPNKNHIKTEGFYFCESDKAMINKIKSIHKAIIEGATYQVNYTTRLKAEVFCPISHLYYQLTMSQNGNYTVLMDTPDIKVASISPELFFQKGDYKGKSNMIVSKPMKGTMPRGKNVKEDELYYNNLKTSSKDMAENVMIVDLLRNDITRIAQSGTIDVPELFSIEKYDTVFQMTSTVCGRLQDDIQLIDMMRALFPCGSITGAPKINTMQYIAQLEDMPRSIYCGTIGLLLPNQRMIFNIPIRTIEYNHEEAVYGVGAGITIDSVPENEVQEFHDKTKILERL

SEQ ID NO: 5608 - protein, 198 aa, Staphylococcus epidermidis
GMNMILMIDNQDSFTCNLIDYIKVQTTEEVKIISVNDLMTQHLDALNPRAIVISPGPGKPSDYPILSSVLEIFHRHVPILGVCLGFQLIIEYFGGNIIHNDKPIHGHITKIRHSNEGIFKGLPSYFNVMRYHSLMADPSTIPSALKVTALNNENVIMAVAHHKYPIYGLQYHPESILSEYGHEQLNLFLTEVGVKYAH

SEQ ID NO: 5609 - protein, 134 aa, Staphylococcus epidermidis
DNDICVVYLYLEVQILNEQKLIKLLEFYKQYKALSGYIDKKYKLTLNDLAVLYLAKIYCLDERILMQTFLKLATGELDISRTKILMSIRRLIDKEKLNKVRSNRDERKIFLYMDENNMSEFDALFEDVEKFLSY

SEQ ID NO: 5610 - protein, 247 aa, Staphylococcus epidermidis
RGDIMKIYSQGDQAIVVSIEKNVSQRLTEDLLSLRAYLIDKSYPFITEIVATESDLMICYDARDMIKHHHIQSPFLYMKALIDSIKLEIRHHRQQLQAKYIQKQQSVNIPVIYGGEFGPDLQHLLKHLKLKLEDFVKLHTQEKYFVSMMGYSPGFPYLTGMNKKLHVNHTSEKKKFIPCGSVIMEGKKCGIVTTDTYNDWLVIGYTPVQLFFPEQQNFTLLKLGDNVTFESKDINEIELGDYKTCQS

SEQ ID NO: 5611 - protein, 580 aa, Staphylococcus epidermidis
RRGITMKEQNPLFFLFKRLSWPYGLIIAAVIITSLGSLSGLLVPLFTGRLVDKFSVSSINWGMIAIFGSIFLVNALLSGIGLYLLSKIGEKIIYAIRSLLWEHIIQLKMPFFDKNESGQLMSRLTDDTKVINEFISQKLPNLLPSVLTLIGSLVMLFIMDWKLTLLTFITIPVFILIIVPLGRVMQKISTNTQSEIANFSGLLGRVLTEMRLVKVSNTERLELDNAHTNLKKIYRLGLKQAKISAVVQPISGVVMLLTIAIILGFGALEIGTGAITPGTLIAMIFYVIQLSMPLINLSTLVTDYKKAVGASSRIYEIMQEPIEPTEALSESKDVTIIDGELVFEHVDFKYDVKKILEDVSFSIPQGEVSAFVGPSGSGKSTIFNLIERMYDIERGDIKYGNQSIFDIPLSKWRTKIGYVMQSNSMMSGTIRDNILYGINRKVDDEELIEYAKLANCHDFIMQFDEGYDTMVGERGLKLSGGQRQRIDIARSFVKNPDILLLDEATANLDSESELKIQEALETLMEGRTTVVIAHRLSTIKKAGQIVFIDKGEVTGKGTHHELMASHDKYRHFVTSQKLSD

SEQ ID NO: 5612 - protein, 277 aa, Staphylococcus epidermidis
SKILENESRGIIMSRLSGEQVKIGYGDSTIINNLDVAIPDGKVTSIIGPNGCGKSTLLKALSRLLSIKEGKINLDGKSIHATSTKEIAKKIAILPQSPEVPDGLTVGELVSYGRFPHQKGFGRLTAEDKKEIDWALSVTGTSEFRHRTINDLSGGQRQRVWIAMALAQRTDIIFLDEPTTYLDICHQLEILNLVKKLNEEEGCTIVMVLHDINQAIRFSDHLITMKAGDIVATGQTDEVLTKDILEKVFNIDGVLDIDPRTGKPILVTYDLFCQTYS

SEQ ID NO: 5613 - protein, 151 aa, Staphylococcus epidermidis
NIILNIKEKNKEMQQIYPSVTHPYQFELNKDFNFSAAHYIPFEEAGKCIRTHGHTYYVNLTIAGNTLDKCGFLVNFRDLKKLVHEQFDHYLLNDLPAFKDKSPSTEIVAQTIYHIIQKELNQRENQPKCVQVYLRETPSSYVVYRPKEDQV

SEQ ID NO: 5614 - protein, 148 aa, Staphylococcus epidermidis
LTIFKFKKMGFKIYGYDINREVSLMAISKINDCFELLAMVTYADRLKGIIKKEFSISFEEFAVLTYISENKEEEYYLKDIINHLNYKQPQVVKAVKNLSQENYFNKKRNEHDERTVLILVDSKQRKKIDDLLKRVNNRITEANNENEV

SEQ ID NO: 5615 - protein, 71 aa, Staphylococcus epidermidis
LKILKVNYQANNPTNAAVSKDTKIPANNIIGTYLETKSDVFLSTIPFNVPIIIPIVEKFAKETKNVDITAL

SEQ ID NO: 5616 - protein, 79 aa, Staphylococcus epidermidis
GGYISMSKTLELVFKSNLNKPVKLLLPDFNAITTEQLIKESMNQLLELDILRFSLGKPVKIYAAQLIDKSTTVIFEDKN

SEQ ID NO: 5617 - protein, 202 aa, Staphylococcus epidermidis
EFNMIIYILINIAIVLLILGFDLYRHRFRQLKFSSILLSVLINSMIDIFAINQFNFITMFTVTLFMIWTLLQIYLNFKLYPFVISDQKFIAIILAIVISLLQFITDKSSTQSVYMSIPYLSPTIFIIGAILLFVGTFKIDEVERLSLFRKIKRPMTTGTIIIILSLISTMILTPFWYVFLIIYSLLIGFILWQGVFFIKDKK

SEQ ID NO: 5618 - protein, 359 aa, Staphylococcus epidermidis
FYDILKKLSYKKLEKLQTNTHLSYLNGIKGIITLKLNRRIHAWRRDMENKPDYFHHIEHRKFQSSSKITLWLSLVITMIFTVVEFVGGIVSNSLALLSDSFHMLSDVLALGLSMVAIYFSSKPPTKNYTYGFLRLEIIVAFLNGLALIVISLGIMYEGIMRIIHPRPVESGIMILIAFIGLIANIVLTIILMISLKKENNINIQSALWHFIGDLLNSLGIIVAFVLIHFTGWNIVDPIISILISLIILRGGYKIIKNASKVLMERVPDRYDTDEIMGAMKDVEGVIDIHEFHLWSVTTNQSSLSAHVVLSDDYIKSPYATINKVSDLLKTQYGLEHVTLQIENINLNHLDEEYFKQLQE

SEQ ID NO: 5619 - protein, 425 aa, Staphylococcus epidermidis
LRDIMKNTQKICYFFSVKSLLLRFIDYSHTSFSMFKIIFGKEKNKVVKTMKVLVAMDEFNGIISSYQANRYVEEAVASQIEDADIVQVPLFNGRHELLDSVFLWQSGNKYRVSAHDADMKETEAIYGQTDSGMTIIEGHLFLNGKKPIQHRSSYGLGEVIKAALDNHTEHLVISLGGIGSFDGGAGMLQALGATFYDDEAQIVDMRKGAYLIKYIRRIDLSGVHPQLTKVNIQLMSDFSSRLYGKKSEIMQTYESLDLSQNEAAEIDNLIWYFSELFKNELKIAMGPIERGGAGGGIAAVLNSLYQAEILTSHELVNQITHLENLIQQADLIIFGEGLKEEDQILETTTIRIAELTQQYSKPAIAICATNDKFDLFESLNVTAMFNTFIDMPDSYTDFKMGIQIRHYTVQALKLLKTQINLPLSS

SEQ ID NO: 5620 - protein, 74 aa, Staphylococcus epidermidis
IYCIITSYIFELFLNYFNFKIKFILFNYKNAPQKLKFSLAFGVHNIVLSILICFQSMTGLKMYLCQAYYINNSE

SEQ ID NO: 5621 - protein, 313 aa, Staphylococcus epidermidis
GECMLTTDRLVNTLNLELLTGEEGLDRPIKNTDISRPGLEMAGYFSHYASDRIQLLGTTELSFYNLLPDEEKKGRMRKLCRPETPAIIVTRGLEPPEELIQASQETHTPIIVAKDATTSLMSRLTTFLEHELAKTTSLHGVLVDVYGVGVLITGDSGIGKSETALELVKRGHRLVADDNVEIKEITKDELVGKPPKLIEHLLEIRGLGIINVMTLFGAGSILTEKQIRLNINLENWNKNKLYDRVGLNEETLKILDTEITKKTIPVRPGRNVAVIIEVAAMNYRLNIMGINTAVEFNERLNEEIVRNSHKSEE

SEQ ID NO: 5622 - protein, 98 aa, Staphylococcus epidermidis
PPGIPRSIMTVFKLARDAYTAAVIPAGPAPIIATSTSTSVILNASYLLIIMRIIYHTFHFINLYAQYKFNCFIQFVSRNIKIVHQLPLGKWLARTTIR

SEQ ID NO: 5623 - protein, 110 aa, Staphylococcus epidermidis
MNLIPTVIETTNRGERAYDIYSRLLKDRIIMLGSQIDDNVANSIVSQLLFLQAQDSEKDIYLYINSPGGSVTAGFAIYDTIQHIKPDVQTICIGMAASMGSFLLAAGAKR

SEQ ID NO: 5624 - protein, 101 aa, Staphylococcus epidermidis; identical to SEQ ID NO: 4755

SEQ ID NO: 5625 - protein, 150 aa, Staphylococcus epidermidis
SFLIYFWLNQWLTKEGDSMKVVYYSFSGNVRRFISRAGIKDTFEITQDNCNESVNEPYILVTGTIGFGEVPQPVQSFLNVNHTQLQAVAASGNRNWGQNFAKAGHTISEEYKVPLMMKFEVQGTNKDIIEFKDKVGNFNENHGRKEIQSY

SEQ ID NO: 5626 - protein, 175 aa, Staphylococcus epidermidis
IKIIKGARKLTQGRQKDELKDITLLGNQNNTYEFDYRPEVLETFDNKHQGRDYFVKFNCPEFTSLCPITGQPDFATIYISYIPNIKMVESKSLKLYLFSFRNHGDFHEDCMNIIMNDLINLMDPHYIEVWGKFTPRGGISIDPYTNYGRPDTKYEKMAEHRLMNHDMYPEKIDNR

SEQ ID NO: 5627 - protein, 95 aa, Staphylococcus epidermidis
SKSIIFATSFMNYSRSFFKYMKLISKSIYLSFIFFIFSLMLFTNQSFANDNKRFQLKPGDIIVTKGPVLNGFLVTVVWQLIMTLYFKLKVQGINQ

SEQ ID NO: 5628 - protein, 335 aa, Staphylococcus epidermidis
NMSIIIENSGLFSSFQDFGRKGYEHEGVIPSGALDELAHEIANRLVANDKNEATLEMTQKMATIRFTEPALIALTGGNFKAETEHMKIYPNKLYLINEGETLKFNETSRTSRVYLAVGGGFKLEKWLHSASTDFNVEIGGFEGRKLKKGDEIELKHHYSQRHLKLFDNLSDKRTTDWGIDGYALSFNYVSDVFHVIKNKGTEDFKKEATRRFTTAEYSVSSKTNRVGMVLDGPQIKAYYDDMPAHQSVKRGTIQVKRDGTPIVLLNDHYTLGSYPQIGTIASYHLTKLAQKPQGSKLKFQFIDIETAEKNLIKYSNWLNQLFHGIEHRMQLEMLK

SEQ ID NO: 5629 - protein, 81 aa, Staphylococcus epidermidis
GKTMSNHNYSDEKIEVIDPSDDRYKGDDYFNKNSSQNNQNLKTFNQTYSYGCTHSGCGCILGCLTISLISFLLSLLIFWII

SEQ ID NO: 5630 - protein, 216 aa, Staphylococcus epidermidis
LMTIAQNGGFLMFSKKKDKFMVQLEEMVFNLDRAAIEFGKMDFNTHLDLKAYSDNIKTYESHGDELMHQVISDLNQTFITPIEREDILSLCNAIDDVLDAMEETSAMFEMYSIEYTDEYMAEFVENIQKAVAEMKLAVGLLVDKKLSHMRIHSINIKEFETNCDGILRQSMKHIFNSETDPITLIKIKDIYQSMEEIADKCQAVANNFETIIMKNS

SEQ ID NO: 5631 - protein, 237 aa, Staphylococcus epidermidis
MAKIPVLEIFGPTIQGEGRVIGRKTMFVRTAGCDYRCSWCDSAFTWDGSAKEDIKLMTAEEIYDALLEIGGHRFNHVTISGGNPALIKGIQELVDLFEDKHIYTALETQGSRFQSWMTQIDDLTISPKPPSSGMKTNLEILDSVINQCTFHSLNLKVVIFDDADYDFAKLIHHRYPNIPFYLQVGNPYLDDNVDQHTDKLLERYEQLVDRVMQSSDMNHVYVLPQLHTLLWSNKKGV

SEQ ID NO: 5632 - protein, 305 aa, Staphylococcus epidermidis
LKKMTSNEKEMGKSELLVVTGMSGAGKSLVIQSLEDMGFFCVDNLPPVLLPKFVELMAQGNPSLQKVAIAIDLRGKELFKSLVKEIDIIKSRNDVILDVMFLEAKTEKIISRYKESRRAHPLNEQGQRSLIDAINEEREHLSEIRSIANYVIDTTKLKPKELKQRISKFYLDENFETFTINVTSFGFKHGIQMDADLVFDVRFLPNPYYVEELRPFTGLDEPVYNYVMKWKETQIFFDKLTDLLKFMIPGYKKEGKSQLVIAIGCTGGQHRSVALAKRLAEYLNEIFEYNVYVHHRDAHIESGGR

SEQ ID NO: 5633 - protein, 358 aa, Staphylococcus epidermidis
VGEIMKLAIIIPVYNAEETIKRAILSVDTSVPYEIICINDGSTDQTQHVLTELQQKHPHIKVIHQSNQGAARSRNVGLEAMSEDVDAFLFLDADDEFLPSRIDLMVNAFNKNKETDVVIGQMARDVNGEWQVISTHQSMVKDAIVTLDRKPDILQSIGPGAKLFSSKYAGLRFDEDVVFCEEHTFIVKAFSKARDIQLIPNIVYGYNEREGSVTAQRADTFLPYMSDALKVRQRVMELLLLLDEKIYYSYRMDNLIVSYLIQAHLKKNNKITQSLLESVIAYMKAMQHTHYSGEAMFRIVRAVEQSATHWTKPLYLQWKKALSEVGIGRPGLIRFKLQVIPKKISFSGKESLKRIFKK

SEQ ID NO: 5634 - protein, 68 aa, Staphylococcus epidermidis
LKEIRGSLMIYLQNFITTTIQLNIYLILVIGLLYVIIHYYRNKGVNAFLDIYLNYIPGTYSRIWPRLI

SEQ ID NO: 5635 - protein, 168 aa, Staphylococcus epidermidis
IILIIQKVTVPLILELLNGESLRQYIQSAYHETLKEEFKNLTPYMTKLAKVHGRSHPYLLKLQDLYREFGDSMLDHIRKEDEEDFPKLIQYSQGQDVQNIKIILEDLINDHEDTGQLLNVMNQLTSDYQTPEEACGTWKLVYQRLQNIERQTHQHVHLENHVLFKKVS

SEQ ID NO: 5636 - protein, 91 aa, Staphylococcus epidermidis
CLVIRSANMKKLLFIITVIILTIVVSACGNESKRDIKQFERQYEEIHQKQHSVEKVMDKIPLKELDNLSKTDTTDKNKKEFVHFNRILITI

SEQ ID NO: 5637 - protein, 355 aa, Staphylococcus epidermidis
KEPITIFSIRSQIIIGVISSVILTTIILVIAYKLMWFNGHMTLTLAITTMITSCLTLSICSIFINPLIQKIKQFNIKTKQFINHEKFIDDETFQSPREIKELNDSFNKMAYEINNQMNMIKNEQQEKTEIIQNLAHDLKTPLAGIRSYSEGLRDGVISDPQEVHEAYEILIKQANRLSILFDDITHVINLNTGRSYPLELIQLDQLLVNILQPYEQHIKQENRTLEVNFCTDIDAFYQYRPPIERILTNLLDNALKFSNSGSRIDIIISECKENDVISISIKDEGIGIVPELQSRIFERTFRVEDSRNTKTGGSGLGLYIANELAQQIDASITVQSDLDIGTTMTLTLKKFQFKK

SEQ ID NO: 5638 - protein, 217 aa, Staphylococcus epidermidis
GETMLTEEKEDYLKAILTNDGDVSFVSNKKLSQFLNIKPPSVSEMVGRLEKEGYVETKHYKGARLTEEGLKQTLDIIKRHRLLELFLIEILQYNWEEVHQEAEILEHRISDLFVERLDKILNFPKTCPHGGVIPRGDQYKEIFTTSILNFEPGERVTVRRVRDKTELLVYLSSKDIYIGNTVEIVSKDDTNKVIILKRNDIVTILSYENAMNIFAEK

SEQ ID NO: 5639 - protein, 521 aa, Staphylococcus epidermidis
IEKMCLLIYLLIRRKRHMNEFFATLSDRKGQLFSTIIEHIQLSFIALFIATLIAVPIAILLTKTKKLSEIVMNIAAVLQTIPSLALLGLMIPIFGIGRLPAIIALVVYALLPILRNTYTGIKEVDPSLIEAAKGIGMKPLRRLTKVELPIAMPVIMAGIRTAMVLIIGTATLAALIGAGGLGDLILLGIDRNNSALILIGAIPAALLAIIFDFILRYMERLSYKKLLISLGTIVIVIIIAIAIPMAAQKGDKITFAGKLGSEPSIITNMYKILIEEDTDDTVEVKDGMGKTSFLFNALKSDEIDGYLEFTGTVLGELTKEDLKSKKENDVYQQAKSSLEKKYDMTMLKPMKYNNTYALAVKRDFAKKYQIKTIGDLRKVEDKLKPGFTLEFNDRPDGYKAVKKTYHLNLSNVKTMEPKLRYTAVKKGDINLIDAYSTDAELKQYNMVVLKDDQHVFPPYQGAPLFKEKYLKDHPEVKKPLNKLANRITDEEMQEMNYKVTVKKEDPYKVAREYLEKEKLIK

SEQ ID NO: 5640 - protein, 95 aa, Staphylococcus epidermidis
RGEIIPMIIEVILMVCLIIIQLMIGHLWHQIGWSYTKAILLMCLPLGIGLYLMQLFYYEPRYTNWEVPLKTKLNLKYMYILTLLEYILIYVCFFM

SEQ ID NO: 5641 - protein, 440 aa, Staphylococcus epidermidis
LKEILNMPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 5642 - protein, 219 aa, Staphylococcus epidermidis
IVVFSYLHSLSLNIIHKRIYYENELCYSMSDFIVYIIFINEEYFMYANVQPFIKNESVKQFTYEYNKVKDVLFTILDSPIKYTQHIGGTCHFNYQTEPILDILVGVNNLHDITSLDEKRLNYAGFYRLHHSYKKKVVMARFNNLSELKQEVRLHIIQMETSLFKQYQTVNHLLHNDKAIAEWFASKKNEIVQHAKKIREYESQKQNLFEKLYKESNLLS

SEQ ID NO: 5643 - protein, 295 aa, Staphylococcus epidermidis
LRRISIKMKIAVMTDSTSYLPQHIIEQYNIPVASLSVTFDDGVNFTESDDFSVDDFYKKMASSKTIPTTSQPAIGDWIENFERLREQGYTDVIVINLSSGISGSYPSATQAGEMVEDIQVHTFDSRLAAMIEGSFAIYAAQLVQKGYKPDDIINELTEIRQHIGAYLIVDDLKNLQKSGRITGAQAWVGTLLKMKPVLRFEEDGKIHPHEKVRTKKRALKSLETNIFKEIEGMEDVTVFVINGDKTEDGKSFLQQLKEDHPNVHIQYCEFGPVIASHLGSGGLGLGYFPRRIDIN

SEQ ID NO: 5644 - protein, 252 aa, Staphylococcus epidermidis
GRGILIMQIKLPKPFFFEEGKRAVLLLHGFTGNSADVRQLGRYLQKKGYTSYAPQYEGHAAPPEEILKSSPFVWFKDVLDGYDYLVDQGYEEIAVAGLSLGGAFALKLSLNRDVKGIITMCAPMENKTEGSIYEGFLEYARNFKKYEGKDQQTIDQEMEQFHPTETLRELSDTLNGVKEHVDEVIDPILVVQAEQDTMIDPQSANYIYNHVDSDEKEIKWYQHSGHVITIDKEKEKVFEDVYQFLESLEWTE

SEQ ID NO: 5645 - protein, 102 aa, Staphylococcus epidermidis
MTFVSHQRHLPIFFKKCVLFFQSISIYIVKGGFIMNEVNQVTIIFTQIKHNSEGKVVEHKRRFSNINPLVSNDQIKSFRSIIERISGEEYDKVEIVKTESLI

SEQ ID NO: 5646 - protein, 567 aa, Staphylococcus epidermidis
NYSVSELILIFCKHSIIYVGDIIVKKLTKMVLSYKLYPTLMLIMSVFLSFTVVAQNISISHFLNHLLYYQQQSLLLLLSVIFISLILRATFNMLIQFLGDHLAFKVKHMLREQVILKKSVRSIGEEINILTESIDGIGPFFQSYLPQVFKSMLIPIVIIITMCFVHLPTAIIMIVTAPFIPLFYVIFGLKTRDESKDQMTYLNQFSQRFLNTAKGLITFKLLNQTKQSEQQLYKDSTRFRDLTMRILKSAFLSGLMLEFISMLGIGLVALEAALSLVVFNHINFVTAAIAIILAPEFYNAIKDLGQAFHTGKQSEGASDVVFSFLESEDKADSPTLKVDEQQFEQVLIKHVDFQYANSNHMALKNISFSVNKGEKVAIVGPSGAGKSTLAKLLSQSVTPTHGTLSFNQASLNIGFLSQRPHIFADSIKNNIAMYDDEICDEQVIQVLDEVGLKEKVLSLKYGIYTSIGEGGEMLSGGQMRRIELSRLLLLKPDIVIFDEPAIGLDIETEKVIQQVLEHHFSTTTVFIIAHRDSTIRSSARRIYIESGHLIKDDSIISVTRSEVKIDQ

SEQ ID NO: 5647 - protein, 62 aa, Staphylococcus epidermidis
FNNVCNMLTDFTKTVAKYIIWYIDDESEMTLWDVNGTTLKRKKPKKIKILVEYMPNLVKKYM

SEQ ID NO: 5648 - protein, 91 aa, Staphylococcus epidermidis
NNNVNSKQKKWVTIMIWYVCAAFFPCILVVLFSVVTRSKWIGTLVTLVIIGASVYKGFFHNEWIIFIDVTSLLAGYLIIDQLEFHKNQNDS

SEQ ID NO: 5649 - protein, 172 aa, Staphylococcus epidermidis
LLNVGVFNYRKRVLIMKKISLFIIFLIRVISGIVIFRQGWEKFTGDFTLNGLVPVIRDNTDSPQWYKWFFEHIVAHTTGLFNIIVPLGEMAIGLGLILGIFAYAASFFGAFVMINYILADMIFTYPLQLAFFIILLMSHSLLAKVSLKEIIAYFRDRNNRGEDKHDPLTNRG

SEQ ID NO: 5650 - protein, 65 aa, Staphylococcus epidermidis
CVNVSSAINLFMRPFIFITYLNHLRYFVNDVKHYGLTPKFIKMVGVLSALTTKFLLMANVMTVNS

SEQ ID NO: 5651 - protein, 219 aa, Staphylococcus epidermidis
DKFVFKNEREVNNMSGISKFISAIVVLLLLIGLAFGIYSFVDSSKKGNERLSDKTTQQEKKKDDKDKKEKKDKKSVEEKKNNTQQTQQVPQTQQTQQTQQTVQTPQRPTTQTPVRQNPQTGEKRAKEPKTDERKKTRQDSSNFKESPNEKDQSSTQQKPQQNKSNQSSENRQSTQNKSNQTQSTRPQNNGNSGNQNASSGQNTQKQNNNNQNSQSSKKD

SEQ ID NO: 5652 - protein, 283 aa, Staphylococcus epidermidis
RNCLKFYQIILKQKEKNNMAMDLITKQDGTTLHYSTMGQGYPVVLVHTAFDNYAVFNDLAKVLAKSFQVVLIDLRGHGYSDKPRNIEFYDFADDIKFLLDAIYIDEAAFIGHEMGALIAADMSVRNPGYISSITLVNPTSIEGELPEERLFRKYAHKIRNWEDDKQEKFLDKRRYYKARKMNKFLKHVVDTNSISTKEEIQAVKDVFKSEGIADVFKHVQVPTLIVAGEHGERTTTLEAKEVADLIQHCEFNVYQHSSAYPFVEEQAQFTQETTNFIQQHAPK

SEQ ID NO: 5653 - protein, 97 aa, Staphylococcus epidermidis
FFNVTSCGELSNTSFVNVLRLNAAKHNTETVIADTTVITVRENAFFLTRYIIGDVNITSVTLTVPFLNRCIALNINETVLLKKKYDPITVKNKIAKG

SEQ ID NO: 5654 - protein, 425 aa, Staphylococcus epidermidis
CFNVLSCSFKLIPIDEIKMLFLQGIHKKIGYEGSNIIFCIMPNLCQYKNLFSQEEMNDIIKIIIEYRLHVAFSIDKIEQIYELNQLFTYQYENLKIMNKCSVSDYNVQFIFNLNEKSIREIYRNILKIQNIELEYKIGLDISCMFNDTAQFKSLASQIKRLKFDYLYIDNARLKSSYLLDNEEGLLLKNILQFKHLIDDLKQFDFSSENLIFLNLYNHQLLNNNEIDLSNSAPLLFKTISKLKKHFKGYGLNVFSNPKVFNAVHLFDENGFKTTFGLIFNHLSWMTNQNQIEQRFYNIIENADQYYLYLYDWRVIESESNESDFKDVDIWINFEDEALIDEYICVIAKVDDEGGNINHMISQNLRHKYVWSTPFLMRVEENFRPYMHIMEHDFKKGPLKIRMKYNAVYLVEIYKKDKINKRRSTT

SEQ ID NO: 5655 - protein, 800 aa, Staphylococcus epidermidis
MSLVYLMATNLLVMLIVLFTLSHRQLRKVAGYVALIAPIVTSTYFIMKIPDVIRNKFIAVRLPWMPSIDINLDLRLDGLSLMFGLIISLIGVGVFFYATQYLSHSTDNLPRFFIYLLLFMFSMIGIVIANNTILMYVFWELTSISSFLLISYWYNNGESQLGAIQSFMITVFGGLALLTGFIILYIITGTNTITDILNQRNAISRHPLFIPMILMLLLGAFTKSAQFPFHIWLPKAMAAPTPVSAYLHSATMVKAGIFLLFRFTPLLGLSNVYIYTVTFVGLITMLFGSLTALRQYDLKGILAYSTISQLGMIMTMVGLGGGYAQHTSDELSKFYILVLFAGLFHLMNHAVFKCALFMGVGIIDHESGTRDIRLLNGMRKVFPKMHIVMLLAALSMAGVPFLNGFLSKEMFLDSLTKANELDQYGFVLTFVIISIGVIASILTFTYALYMIKETFWGNYNIEKFKRKQIHEPWLFSLPAVILMLLIPVIFFVPNVFGNFVILPATRSVSGIGAEVDAFVPHISQWHGVNLPLILSIVVIIIGLILALVVNWKEVTHQIIKSASITDGYRKIYREFELYSARGIRALMNNKLNYYIMITLFIFVAIVVYGYLTVGFPHVHQLHISSFGPLEVILSVVTLIIGISLIFIRQRLTMVVLNGMIGFAVTLYFIAMKAPDLALTQLVVETITTILFIVSFSRLPNIPRVKANLKKETFKIIVSLVMALTVVSLIFVAQQADGMPSIAKFYEDAYELTGGKNIVNAILGDFRALDTMFEGLVLIIAGLGIYTLLNYKDRRGQDERE

SEQ ID NO: 5656 - protein, 237 aa, Staphylococcus epidermidis
KRIVKVMEATCMDKKKLIKTLINVLPIVIVPLVTERKRIKEHPDVQKVTNATSKATSKTTSAISNKASDVKEYVGDKKQEFDNKRELKKIAKENDPAYIEKKGEKLAKQNRKEADKMDKKLQKNIEKRHKEEQKQREANQKQRIKDMKKTQKYEEQVGLTPGKIDHEIEKKGEKLEKDNRKDIKKLDKKLQKNIEKRHKEEQKQREEAEKARKKEFKKYENYVADSVVKQHKESNHS

SEQ ID NO: 5657 - protein, 143 aa, Staphylococcus epidermidis
MMIVIVTLTLRRWIDMAIVNKVIIVEGKSDKKRVQQVIAEPANIICTHGTMSIDKIDNMIETLYDKQVYVLADSDDEGEKIRKWFKRYLSESEHIYVDKTFCEVAKCPKNYLAHVLSRYGFNVKKEKKLMNNLKTERLVLVNE

SEQ ID NO: 5658 - protein, 637 aa, Staphylococcus epidermidis
LMQVIIMQESKNLMRIKSNLKQPMKQTSRDGVSLRKLKNNKGNVIMQETLSHYFGYKSFRPGQEEIITKILNHQHTLGVLPTGGGKSICYQVPGLMQGGTTIVISPLISLMKDQVDQLQAMGIQAAYLNSSLTHKQQKEIEEQIKRGAIQFLYVAPERFENTFFLNLLRKIEIPLIAFDEAHCISKWGHDFRPSYQSVIQKVFTLPQNFTIVALTATATAEVQQDIMSKLSIGQNDVVKTSTKRRNLIFKVNPTYQRQKFVVDYVANHEGQAGIIYCSTRKQVEELHEALNSEKIKSTIYHAGLTNKERIEAQNDFLYDRVEVVIATNAFGMGIDKSNVRYVIHYNMPGDLESYYQEAGRAGRDGLKSECILLFSERDKGLHEYFITVSQADDDYKDKMGEKLTKMIQYTKTKKCLEATIVHYFEPNENLEECNQCSNCIQENKTYDMTREAKMIISCIARMKQQENYSVIIQVLRGEVTDYIKHHHYNELTTHGLMKNYTTSELSHLIDELRFKGYLNENDEILMCDTSVKQLLNNHTKVYTTPFKQKTKEKVFINTVEGVDRALYRELVDVRKQLSDKLGIAPVSIFSDYTLEEFAKRKPESKQEMIAIDGVGSYKLKHYCPKFIETIQSYKTRI

SEQ ID NO: 5659 - protein, 160 aa, Staphylococcus epidermidis
VKQVVLNIVIAFLWVLFQDEDEFKFTTFFAGFLIGLIVIYILHRFFGEEFYLKKIWVAIKFLAVYLYQLITSSISTINYILFKTNEVNPGLLTYETSLKSNWAITFLTILIIITPGSTVIRISKNTNKFFIHSIDVSEKDKENLLKSIKQYEDLILEVTR

SEQ ID NO: 5660 - protein, 61 aa, Staphylococcus epidermidis
DNKVYSCKVTRLHNHALLSIECDNRELMITFTVRDIKQFEVCSGYTDVKAKKNYTGIFIRL

SEQ ID NO: 5661 - protein, 639 aa, Staphylococcus epidermidis
ERKVYLVASIMSFNEIIFKNFKQNVTHYAIYLLSLVISVVLYFSFVTLKYAHHLHGNQSFPAIKEGSQVGSYFLFIIIVVFLLYANFLFLKRRGRELSLLQIIGLTKKDIMKMIMLEQLMTFMMTTIVGIILGIFGSKILLMIVLRLLGINVSVSIIFNYHAILETLLLIAVSYVLIVFQSYVYLLKRSIKELASDVNKKEFSHTRTTLGEVVLGLLGIIMIVSGYIMSTKLVDNVETIIQPFAILFLTVIGSYFFFRSTVSLIFKAIQRLRNGTVSVTDVMFTSPIIYRVKKNAFSLTVMTVVSAITVSVLCFAALSRSTLTNEVLLSSPHDVTLKNQKQANELAFKLNNRNIEHYYNYKEVVYAKVYKDHLFSEGVYRPKEITVTSDKYIPNVSTKKGQTDIIIPRGSLKDVVKTDKKRTAYVGSKKFRLKVSLRKGINKVYFMSDVDRGRPTLILNDEDYQKIREHIKEKNIVSQYGFDLKNKNDLPELEKLVSSINEDIETRSEAASEISSLTGILLFVTSFLGITFLIAAGCIIYIKQIDETEDELENYTILRKLGFTHQDMSKGLKLKVIFNFGLPLIIALLHAYFASLAYMHLMNVTNQIPIFIVMAVYTATYAVFAIIAYNHSKRTIKHSI

SEQ ID NO: 5662 - protein, 224 aa, Staphylococcus epidermidis
EDEVVVTKALLPSQQRIDLNSSMLLEKSLIKYRRHIMKRIAVYCGASKGKNPSYVKEAYELGKYMAEQGYELVFGAGSVGIMGAIQDGILEHGGKAIGVMPKMLDEREITSQKVSELILVDSMHERKNKMTELADAFIMAPGGAGSLEEFFEMYSWAQIGIHQKPIGVFNLNGFFEPLQHLIDHMIKEGFIDEKYQKLAPLYDTKESLIEGLKHYKPLGVRTYD

SEQ ID NO: 5663 - protein, 65 aa, Staphylococcus epidermidis
LKFLRRRIYLSLKEIWKVLINKKWQTEEICYLILYIFLASIFTTPLFGIPLGVLAYLYLNEEILK

SEQ ID NO: 5664 - protein, 176 aa, Staphylococcus epidermidis
LQLFRLSVRSQFQDSSGKDVSSMEIIKDIVSLIASILIFLGSIIALISAIGIVKFQDVFLRSHASTKSSTLSVLLTVVGVLIYFIVNSGFFSVRLLLSLVFINLTSPVGMHLISRAAYRNGAYMYRKDDASRQSTILLSQKEFNTPEELKKRAKLREERREKLYYKEKEYINKMDD

SEQ ID NO: 5665 - protein, 181 aa, Staphylococcus epidermidis
ELIFMKPKVLLAGGTGYIGRYLSRVIEHDAQLFALSKYPKPDKGSTNKITWLKRDIYNHKDVVEAMKGIDIAVYYLDPTKHSAKLTHATARDLNFIAADNFGRAASINKLKKIVYIPGSRHDNEAIERLGAYGVPVDCTDVEVKRPHINVELQTAKYDDVRTAMKMILPKKMDAQSTCRLF

SEQ ID NO: 5666 - protein, 74 aa, Staphylococcus epidermidis
YESFSIISPSFMTIILLNLGSISKSCVAMMSVWDKDSIKFIIFWVLLISSAVVGSSNIQKPAEGLNSNLAKLRR

SEQ ID NO: 5667 - protein, 309 aa, Staphylococcus epidermidis
IGTLKIICERVMLQMKSKLWIVICALIVVLAACGQDANHSSNNKDTEKSDKKYHRIISLIPSNTEILYRLGIGEDIVGVSTVDDYPKDVKKGKKQFDAMNLNKEELIKAKPDLILAHESQKNSAGKVLKSLKDKGVKVVYVKDAQSIDETYDTFKSIGQLTDREKQAKELVDETKHNVEKIINSVPKHHKKQEVFMEVSSKPDIYTAGKDTFFNDMLEKLDAKNSFDDVKGWKSVSKESIIKRNPDILISTEGKSKSDYIEMIKKRGGFDKINAVKNTRIETVDGDEVSRPGPRIDEGLKDLRDDIYKK

SEQ ID NO: 5668 - protein, 69 aa, Staphylococcus epidermidis
PMTLLWLAILILLTVLGKKMSNQAIKNNQVLIAKLIATITTFCAFVLVYLLMQSIMPHIIKLMNVFYHH

SEQ ID NO: 5669 - protein, 291 aa, Staphylococcus epidermidis
SMFLLELIKGIILGIVEGLTEFAPVSSTGHMILVDDMWLKSTNFLGSQSAFTFKVVIQLGSVFAAAWVFRERFLEILHIGQHKPEPSTSGDRRSKPRRLNLIHVLVGMVPAGILGFLFDDLIEKYLFSVPTVLIGLFIGAIYMIIADKYSKTVQHPQTVDQINYFQAFVIGISQAIAMWPGFSRSGSTISTGVLMKLNHKAASDFTFIMSVPIMLAASGLSLLKHYEYIHLAHIPFYILGFLAAFIVGLIAIKTFLHLINKVKLVPFAIYRIVLVIFIAILYFGFGIGKGI

SEQ ID NO: 5670 - protein, 117 aa, Staphylococcus epidermidis
LIKFYQYPKCTTCKKAAKFLDEHDVNYESIDIVQHTPTKKEFKNIVDKTGVNINKLFNTHGIKYRELNLKEKLKNMSDDEKLELLASDGMLVKRPLAISGNHLTLGFKENEYQHQWL

SEQ ID NO: 5671 - protein, 98 aa, Staphylococcus epidermidis
MNKLKDIEDITVNFNKEKHLIFGYTPMCGTCKISERMLDIANEILQLPIKKIDLNFYPEWSKEKQIMSVPVLLLMRREEEIKRIYAFQSVTYLLENLK

SEQ ID NO: 5672 - protein, 325 aa, Staphylococcus epidermidis
LMKFIFKGYTLFILLVILTIVSLFIGVSQLSLIDIFHLSDEQINILFSSRIPRTVSILLSGSSLALSGLIMQQMMQNKFVSPTTAGTMEWAKLGILMSLLFFPNGPILIKLLFAVVLSIVGTFLFVQLINLIRVKDVIFVPLLGIMIGGILSSFTTFVALRTNALQSIGNWLTGNFAVITSGRFEVLYLTIPLLILAFVFANHFTIAGMGKDFSHNLGVSYEKIIKIALFITATLTALVVVTVGTLPFLGLIVPNIISIYRGDHLKNALPHTLMLGAIFVLIADIIGRIIVYPYEINIGLTIGVFGTIIFLILLMKGRKNYANER

SEQ ID NO: 5673 - protein, 449 aa, Staphylococcus epidermidis
LETSTIISLVIFFLLIALTTVFVGSEFALVKVRSTRIEQLVDEGNKSAKIVKKMIDNLDYYLSACQLGITVTSLGLGWLGEPTFEKMMHPLFELLHLPSPLTTTISFVVSFIVVTYLHVVLGELAPKSFAIQHTEQLALLYSRPLFYFGNFMKPLIWLMNGSSRVIVRMFGFDPDAQTDAMSEEEIKIIINNSYNGGEINQTELAYMQNIFSFDERHAKDIMVPRTQMVTLNEPFNVDELLDTIKEHQFTRYPITEDGDKDHVKGFINVKEFLTEYASGKPIKIANYIHELPMISETTRISDALVRMQREHVHISLIIDEYGGTAGILTMEDILEEIVGEIRDEFDDDEVNDIVKLDDHTYQINGRVLLDDLNEKFGIEFEDSEDIDTIGGWLQSQNTNLQKDDFVDTEYDRWTITEIDNHQIIWVNLNYEFNSGRPSVNEEQEDDERD

SEQ ID NO: 5674 - protein, 502 aa, Staphylococcus epidermidis
FMTSNKSHEKAVQEIPQHGFFGHPKGLGVLFFVEFWERFSYYGMRAMLIFYMYFALQENGLGMDKTTAMSIMSVYGSLIYMSSIPGGWIADRITGTRGATLIGAILIIIGHICLSLPFAMVGLFTSMFFIIVGSGLMKPNISNIVGRLYPENDVRMDAGFVIFYMSVNMGALVSPIILQHYIDIRNFHGGFLIAAIGMALGLVWYLLFNRKTLGSIGMKPTNPLSSSEKKKYGTIIGIVVIAIVLILMIAYFTHTLSFNLISNTVLILGIALPIIYFTTMIRSKEVTDTERSRVKAFIPLFILGMLFWSIQEQGSNVLNIYGIENSDMKLNLFGWKTHFGEAIFQTINPLFILLFAPVVTLLWQKLGKKQPSLPIKFAIGTILAGASYILMGAIGHIYGDTQFSVNWVILSYVICVIGELCLSPTGSSAAVKLAPKAFNAQMMSLWLLTNASAQAINGTLVKLIKPLGQTNYFIFLGVVATVITLIILAFIPKISKAMKGIR
